(12) United States Patent
Pavco et al.

(10) Patent No.: US 6,346,398 B1
(45) Date of Patent: Feb. 12, 2002

(54) METHOD AND REAGENT FOR THE TREATMENT OF DISEASES OR CONDITIONS RELATED TO LEVELS OF VASCULAR ENDOTHELIAL GROWTH FACTOR RECEPTOR

(75) Inventors: Pamela Pavco, Lafayette; James McSwiggen; Daniel Stinchcomb, both of Boulder, all of CO (US); Jaime Escobedo, Alamo, CA (US)

(73) Assignee: Ribozyme Pharmaceuticals, Inc., Boulder, CO (US)

( * ) Notice: Subject to any disclaimer, the term of this patent is extended or adjusted under 35 U.S.C. 154(b) by 0 days.

(21) Appl. No.: 08/584,040

(22) Filed: Jan. 11, 1996

Related U.S. Application Data

(60) Provisional application No. 60/005,974, filed on Oct. 26, 1995.

(51) Int. Cl.$^7$ .............................. C12Q 1/68; C12P 19/34; C07H 21/04; C12N 15/85; C12N 15/86

(52) U.S. Cl. ....................... 435/91.31; 435/6; 435/91.1; 435/325; 435/375; 514/44; 536/23.1; 536/24.5; 536/23.2

(58) Field of Search .......................... 514/44; 435/325, 435/320.1, 6, 91.31, 91.1, 440, 366, 375; 536/24.5, 23.1, 23.2, 24.3

(56) References Cited

U.S. PATENT DOCUMENTS

| | | | | |
|---|---|---|---|---|
| 4,987,071 | A | | 1/1991 | Cech et al. ..................... 435/91 |
| 5,334,711 | A | | 8/1994 | Sproat et al. ............... 536/24.5 |
| 5,359,051 | A | | 10/1994 | Cook et al. ................. 536/26.7 |
| 5,496,698 | A | * | 3/1996 | Draper et al. .................... 435/6 |
| 5,525,468 | A | * | 6/1996 | McSwiggen .................... 435/6 |
| 5,712,380 | A | * | 1/1998 | Kendal et al. .............. 536/23.5 |

FOREIGN PATENT DOCUMENTS

| | | |
|---|---|---|
| EP | 0360257 | 3/1990 |
| WO | 9103162 | 3/1991 |
| WO | 9207065 | 9/1991 |
| WO | 9323569 | 4/1993 |
| WO | 9315187 | 8/1993 |
| WO | 9323057 | 11/1993 |
| WO | 9402595 | 2/1994 |
| WO | 9411499 | 5/1994 |
| WO | 9421679 | 9/1994 |
| WO | 9504142 | 2/1995 |
| WO | 9504818 | 2/1995 |
| WO | 9513380 | 5/1995 |
| WO | 9521868 | 8/1995 |
| WO | 9523225 | 8/1995 |

OTHER PUBLICATIONS

Beigelman et al., Beigelman et al., "Chemical Modification of Hammerhead Ribozymes," *J. Biol. Chem.* 270:25702–25708 (1995).

Carter, "Adeno–Associated Virus Vectors," *Curr Opi. Biotech.* 3:533–539 (1992).

Chen et al., "Multitarget–Ribozyme Directed to Cleave at up to Nine Highly Conserved HIV–1 env RNA Regions Inhibits HIV–1 Replication–Potential Effectiveness Against Most Presently Sequenced HIV–1 Isolates," *Nucleic Acids Research* 20:4581–4589 (1992).

Chowrira et al., "In Vitro and in Vivo Comparison of Hammerhead, Hairpin, and Hepatitis Delta Virus Self–Processing Ribozyme Cassettes," *J. Biol. Chem.* 269:25856–25864 (1994).

Chowrira and Burke, "Extensive Phosphorothioate Substitution Yields Highly Active and Nuclease–Resistant Hairpin Ribozymes," *Nucleic Acids Res.* 20:2835–2840 (1992).

Collins and Olive, "Reaction Conditions and Kinetics of Self–Cleavage of a Ribozyme Derived From Neurospora VS RNA," *Biochemistry* 32:2795–2799 (1993).

Dropulic et al., "Functional Characterization of a U5 Ribozyme: Intracellular Suppression of Human Immunodeficiency Virus Type I Expression," *Journal of Virology* 66:1432–1441 (1992).

Duval–Valentin, "Specific inhibition of transcription by triple helix–forming oligonucleotides," *Proc. Natl. Acad. Sci. USA* 89:504 (1992).

Egholm et al., "PNA hybridizes to complementary oligonucleotides obeying the Watson–Crick hydrogen–bonding rules," *Nature* 365:566–568 (1993).

Elroy–Stein and Moss, "Cytoplasmic Expression System Based on Constitutive Synthesis of Bacteriophage T7 RNA Polymerase in Mammalian Cells," *Proc. Natl. Acad. Sci. USA* 87:6743–6747 (1990).

Folkman and Shing, "Angiogenesis," *J. Biol. Chem.* 267:10931–10934 (1992).

Folkman, "What is the Evidence that Tumors are Angiogenesis Dependent?" *Journal of the National Cancer Institute* 82:4–6 (1990).

Gao and Huang, "Cytoplasmic Expression of a Reporter Gene by Co–Delivery of T7 RNA Polymerase and T7 Promoter Sequence with Cationic Liposomes," *Nucleic Acids Res.* 21:2867–2872 (1993).

Guerrier–Takada et al., "The RNA Moiety of Ribonuclease P Is the Catalytic Subunit of the Enzyme," *Cell* 35:849–857 (1983).

Hampel et al., "'Hairpin' Catalytic RNA Model: Evidence for Helices and Sequence Requirement for Substrate RNA," *Nucleic Acids Research* 18:299–304 (1990).

Hampel and Tritz, "RNA Catalytic Properties of the Minimum a(–)sTRSV Sequence," *Biochemistry* 28:4929–4933 (1989).

Haseloff and Gerlach, "Simple RNA Enzymes with New and Highly Specific Endoribonuclease Activities," *Nature* 334:585–591 (1988).

(List continued on next page.)

*Primary Examiner*—George C. Elliott
*Assistant Examiner*—Janet Epps

(57) ABSTRACT

Nucleic acid molecule which modulates the synthesis, expression and/or stability of an mRNA encoding one or more receptors of vascular endothelial growth factor.

23 Claims, 20 Drawing Sheets

OTHER PUBLICATIONS

Hertel et al., "Numbering System for the Hammerhead," *Nucleic Acids Res.* 20:3252 (1992).

Izant and Weintraub, "Constitutive and Conditional Suppression of Exogenous and Endogeneous Genes by Anti-Sense RNA," *Science* 229:345–352 (1985).

Jaeger et al., "Improved Predictions of Secondary Structures for RNA," *Proc. Natl. Acad. Sci. USA* 86:7706–7710 (1989).

Jeffries and Symons, "A Catalytic 13–mer Ribozyme," *Nucleic Acids Research* 17:1371–1377 (1989).

Jellinek et al., "Inhibition of Receptor Binding by High–Affinity RNA Ligands to Vascular Endothelial Growth Factor," *Biochemistry* 33:10450–10456 (1994).

Kashani–Sabet et al., "Reversal of the Malignant Phenotype by an Anti–ras Ribozyme," *Antisense Research & Development* 2:3–15 (1992).

Kim et al., "Inhibition of vascular endothelial growth factor–induced angiogenesis suppresses tumour growth in vivo," *Nature* 362:841–844 (1993).

L'Huillier et al., "Cytoplasmic Delivery of Ribozymes Leads to Efficient Reduction in α–Lactalbumin mRNA Levels in C1271 Mouse," *Embo J.* 11:4411–4418 (1992).

Lieber et al., "Stable High–Level Gene Expression in Mammalian Cells by T7 Phage RNA Polymerase," *Methods Enzymol.* 217:47–66 (1993).

Lisziewicz et al., "Inhibition of Human Immunodeficiency Virus Type 1 Replication by Regulated Expression of a Polymeric Tat Activation Response RNA Decoy as a Strategy for Gene Therapy in AIDS," *Proc. Natl. Acad. Sci. U.S.A.* 90:8000–8004 (1993).

McGarry and Lindquist, "Inhibition of heat shock protein synthesis by heat–inducible antisense RNA," *Proc. Natl. Acad. Sci. USA* 83:399–403 (1986).

Millauer, "High Affintiy VEGF Binding and Developmental Expression Suggest Flk–1 as a Major Regulator of Vasculogenesis and Angiogenesis," *Cell* 72:835–846 (1993).

Milligan and Uhlenbeck, "Synthesis of Small RNAs Using T7 RNA Polymerase," *Methods Enzymol.* 180:51–62 (1989).

Ohkawa et al., "Activities of HIV–RNA Targeted Ribozymes Transcribed From a 'Shot–Gun' Type Ribozyme–trimming Plasmid," *Nucleic Acids Symp. Ser.* 27:15–16 (1992).

Ojwang et al., "Inhibition of Human Immunodeficiency Virus Type 1 Expression by a Hairpin Ribozyme," *Proc. Natl. Acad. Sci. USA* 89:10802–10806 (1992).

Perreault et al., "Mixed Deoxyribo– and Ribo–Oligonucleotides with Catalytic Activity," *Nature* 344:565–567 (1990).

Perrotta and Been, "Cleavage of Oligoribonucleotides by a Ribozyme Derived from the Hepatitis δ Virus RNA Sequence," *Biochemistry* 31:16–21 (1992).

Pieken et al., "Kinetic Characterization of Ribonuclease–Resistant 2'–Modified Hammerhead Ribozymes," *Science* 253:314–317 (1991).

Plate, "Vascular endothelial growth factor is potential tumor angiogenesis factor in human gilomas in vivo," *Nature* 359:845–848 (1992).

Rossi et al, "Ribozymes as Anti–HIV–1 Therapeutic Agents: Principles, Applications, and Problems," *Aids Research and Human Retroviruses* 8:183–189 (1992).

Sarver et al., "Ribozymes as Potential Anti–HIV–1 Therapeutic Agents" *Science* 247:1222–1225 (1990).

Saville and Collins, "A Site–Specific Self–Cleavage Reaction Performed by a Novel RNA In Neurospora Mitochondria," *Cell* 61:685–696 (1990).

Saville and Collins, "RNA–Mediated Ligation of Self––Cleavage Products of a Neurospora Mitochondrial Plasmid Transcript," *Proc. Natl. Acad. Sci. USA* 88:8826–8830 (1991).

Scanlon et al., "Ribozyme–Mediated Cleavage of c–fos mRNA Reduces Gene Expression of DNA Synthesis Enzymes and Metallothionein," *Proc. Natl. Acad. Sci. USA* 88:10591–10595 (1991).

Scaringe et al., "Chemical synthesis of biologically active oligoribonucleotides using β–cyanoethyl protected ribonucleoside phosphoramidites," *Nucl. Acids Res.* 18:5433–5441 (1990).

Stein and Cheng, "Antisense Oligonucleotides as Therapeutic Agenst—Is the Bullet Really Magical?" *Science* 261:1004–1288 (1993).

Taira et al., "Construction of a novel RNA–transcript–trimming plasmid which can be used both in vitro in place of run–off and (G)–free transcriptions and in vivo as multi–sequences transcription vectors," *Nucleic Acids Research* 19:5125–5130 (1991).

Thompson et al., "Improved accumulation and activity of ribozymes expressed from a tRNA–based RNA polymerase III promoter," *Nucleic Acids Research* 23:2259–2268 (1995).

Torrence et al., "Targeting RNA for degradation with a (2'–5') oligoadenylate–antisense chimera," *Proc. Natl. Acad. Sci. USA* 90:1300–1304 (1993).

Uhlenbeck, "A Small Catalytic Oligoribonucleotide," *Nature* 328:596–600 (1987).

Usman et al.,"Automated Chemical Synthesis of Long Oligoribonucleotides Using 2'–O–Silylated Ribonucleoside 3'–O–Phosphoramidites on a Controlled–Pore Glass Support: Synthesis of a 43–Nucleotide Sequence Similar to the 3'–Half Molecule of an *Escherichia coli* Formylmethoionine tRNA," *J. Am. Chem. Soc.* 109:7845–7854 (1987).

Usman and Cedergren, "Exploiting the chemical synthesis of RNA," *TIBS* 17:334–339 (1992).

Usman et al., "Chemical modification of hammerhead ribozymes: activity and nuclease resistance," *Nucleic Acids Symposium Series* 31:163–164 (1994).

Ventura et al., "Activation of HIV–Specific Ribozyme Activity by Self–Cleavage," *Nucleic Acids Research* 21:3249–3255 (1993).

Weerasinghe et al., "Resistance to Human Immunodeficiency Virus Type 1 (HIV–1) Infection in Human CD4+ Lymphocyte–Derived Cell Lines Conferred by Using Retroviral Vectors Expressing an HIV–1 RNA–Specific Ribozyme," *Journal of Virology* 65:5531–5534 (1994).

Wincott et al., "Synthesis, deprotection, analysis and purification of RNA and ribozymes," *Nucleic Acids Research* 23:2677–2684 (1995).

Yu et al., "A Hairpin Ribozyme Inhibits Expression of Diverse Strains of Human Immunodeficiency Virus Type 1," *Proc. Natl. Acad. Sci. USA* 90:6340–6344 (1993).

Zabner et al., "Adenovirus–Mediated Gene Transfer Transiently Corrects the Chloride Transport Defect in Nasal Epithelia of Patients with Cystic Fibrosis," *Cell* 75:207–216 (1993).

Zhou et al., "Synthesis of Functional mRNA in Mammalian Cells by Bacteriophage T3 RNA Polymerase," *Mol. Cell. Biol.* 10:4529–4537 (1990).

Andrea D. Branch, A good antisense molecule is hard to find, TIBS, 47–48, Feb. 1998.*

Eugene Uhlmann and Anusch Peyman, Antisense Oligonucleotides: A new Therapeutic Principle, Chemical Reviews, pp. 545–546, Jun. 1990.*

Shibuya, M. et al., Nucleotide sequence and expression of a novel human receptor–type tyrosine kinase gene (flt) closely related to the fms family, Oncogene, 5, pp. 519–524, 1990.*

Stanley T. Crooke, Basic Principles of Antisense Therapeutics, Springer–Verlag, NY, p. 3, Jul. 1998.*

* cited by examiner

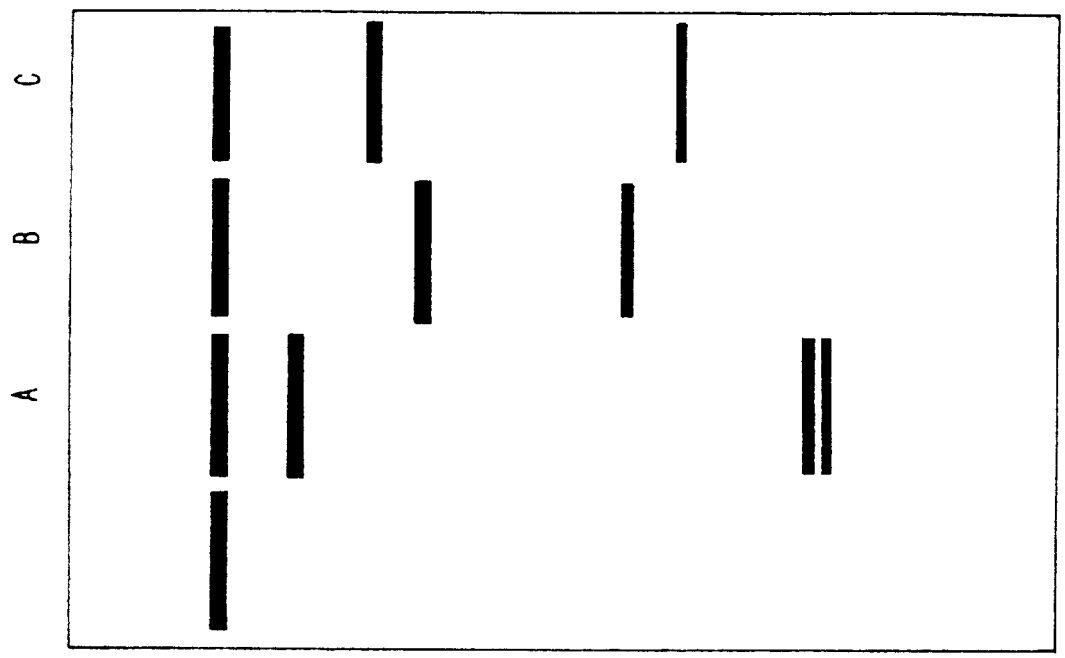
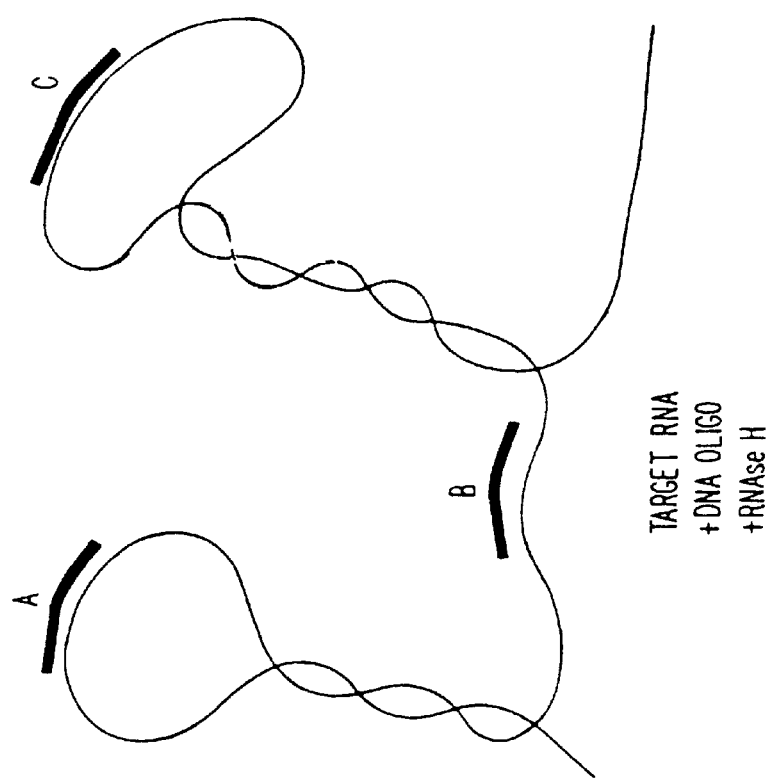
FIG. 6.

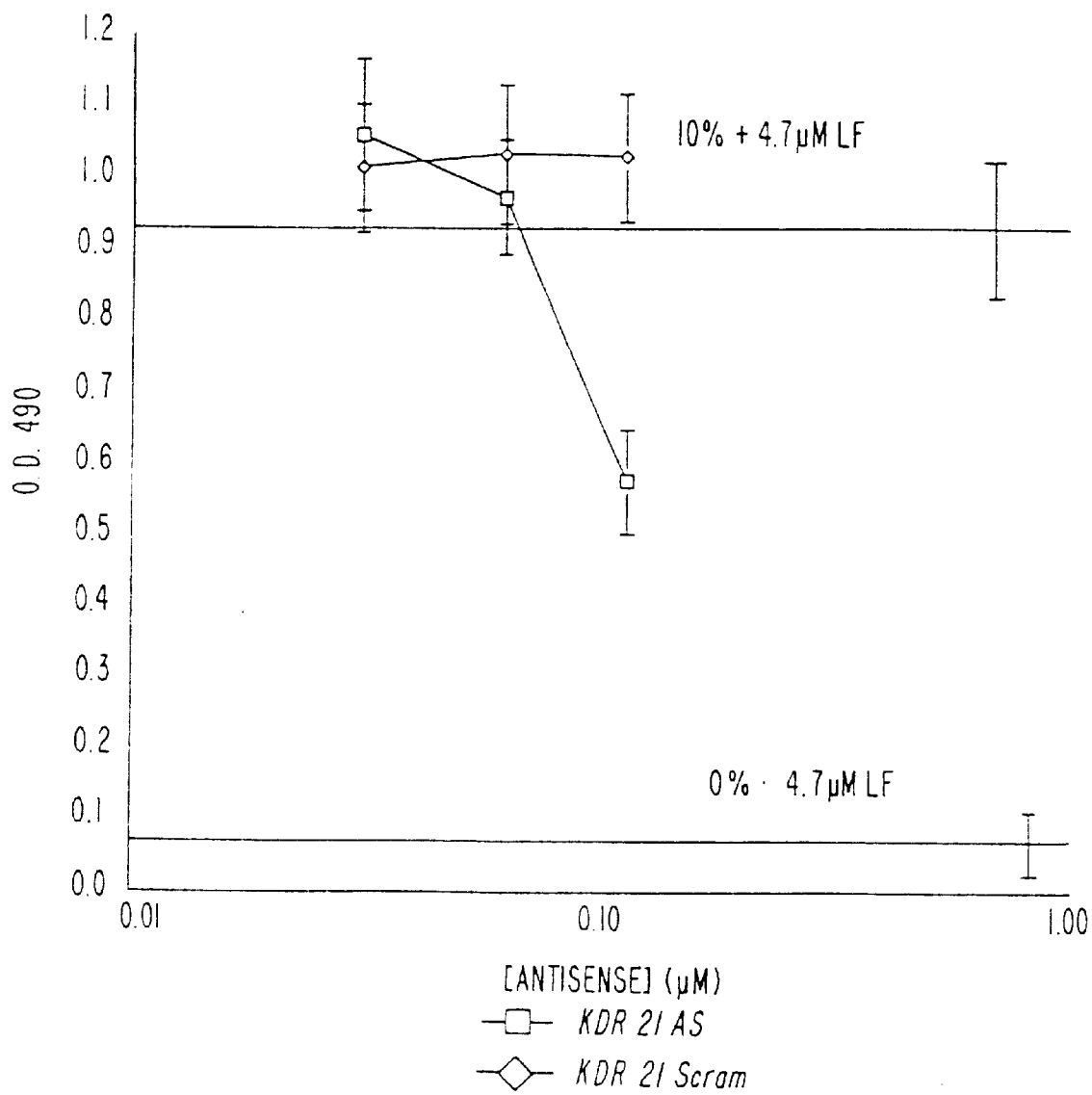

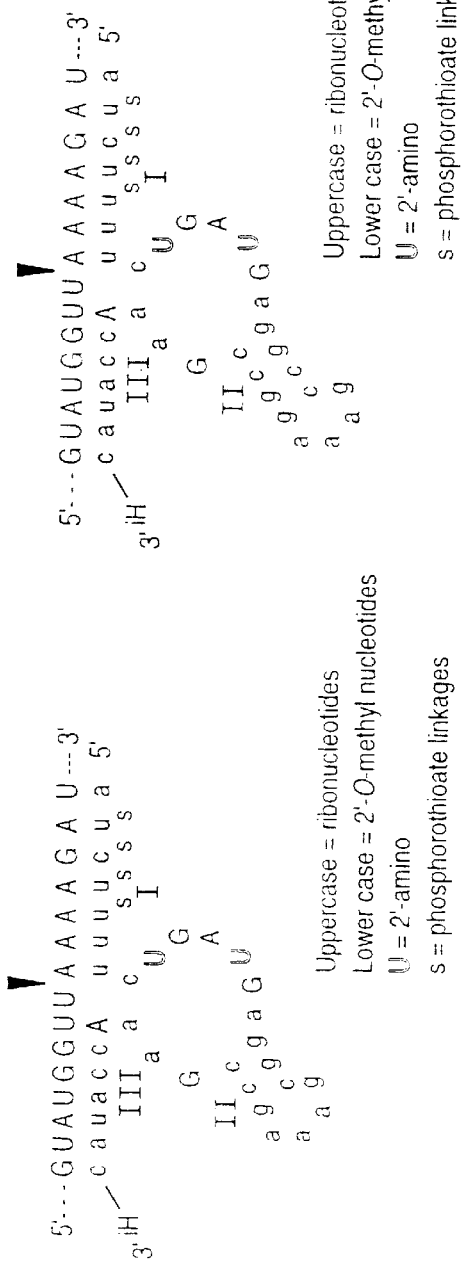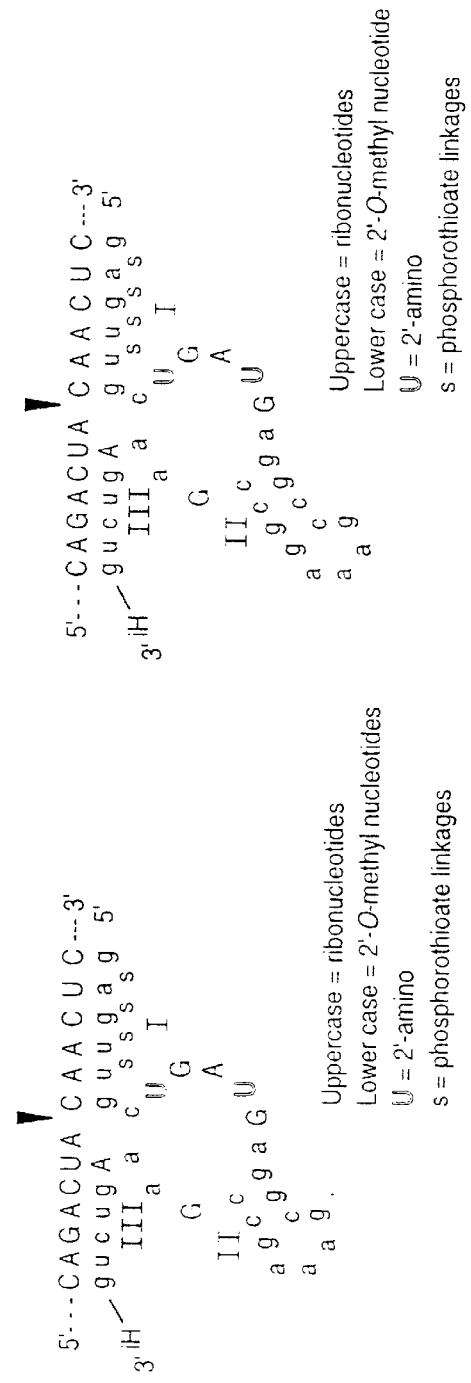
FIG. 11A.

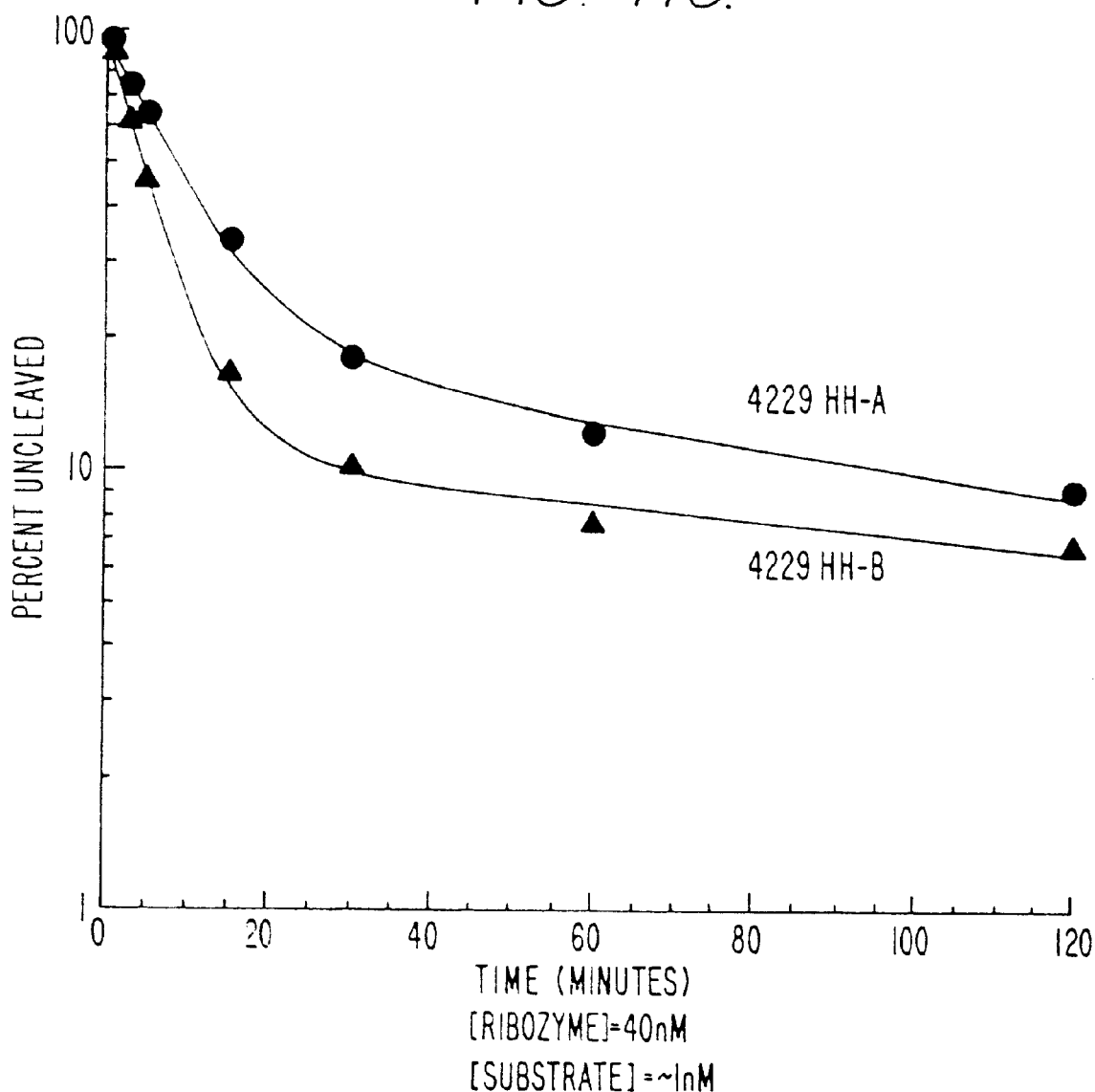

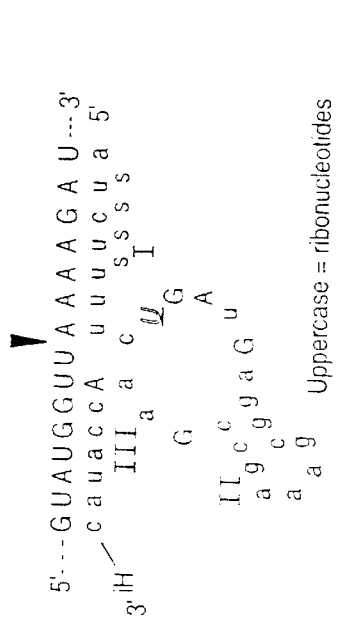
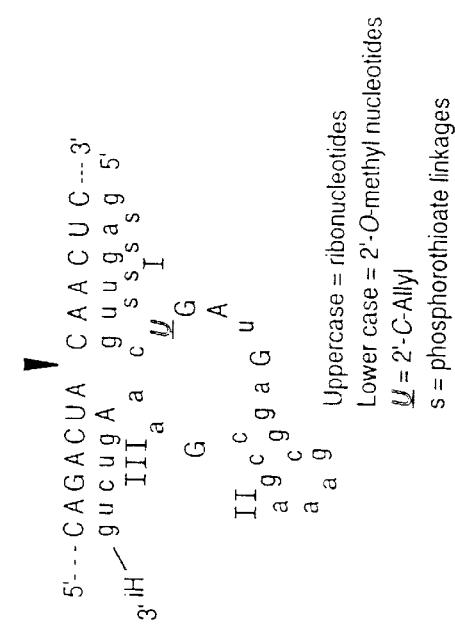
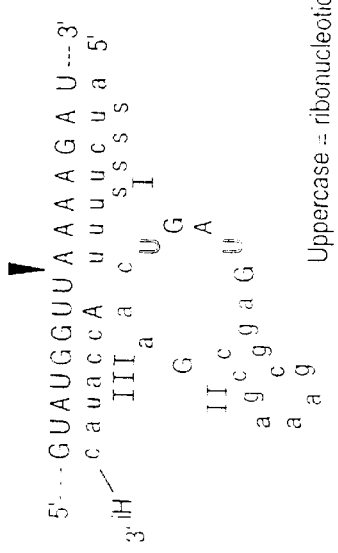
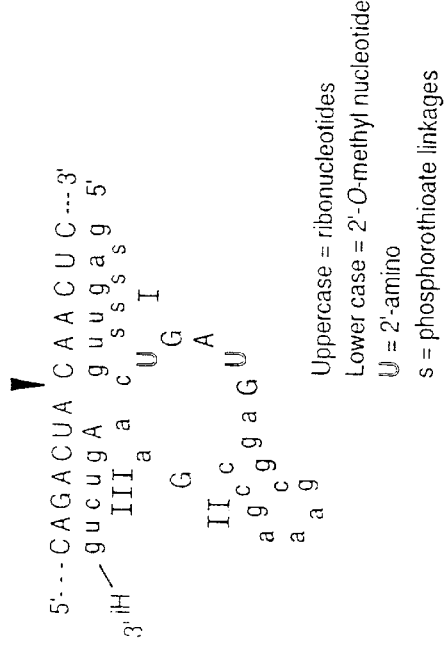
FIG. 12A.

METHOD AND REAGENT FOR THE TREATMENT OF DISEASES OR CONDITIONS RELATED TO LEVELS OF VASCULAR ENDOTHELIAL GROWTH FACTOR RECEPTOR

RELATED APPLICATIONS

This application claims the benefit of Pavco et al., U.S. Ser. No. 60/005,974, entitled Method and Reagent for the Treatment of Diseases or Conditions Related to Levels of Vascular Endothelial Growth Factor Receptor, filed Oct. 26, 1995, which is incorporated by reference herein in its entirety, including drawings.

BACKGROUND OF THE INVENTION

This invention relates to methods and reagents for the treatment of diseases or conditions relating to the levels of expression of vascular endothelial growth factor (VEGF) receptor(s).

The following is a discussion of relevant art, none of which is admitted to be prior art to the present invention.

VEGF, also referred to as vascular permeability factor (VPF) and vasculotropin, is a potent and highly specific mitogen of vascular endothelial cells (for a review see Ferrara, 1993 *Trends Cardiovas. Med.* 3, 244; Neufeld et al., 1994 *Prog. Growth Factor Res.* 5, 89). VEGF induced neovascularization is implicated in various pathological conditions such as tumor angiogenesis, proliferative diabetic retinopathy, hypoxia-induced angiogenesis, rheumatoid arthritis, psoriasis, wound healing and others.

VEGF, an endothelial cell-specific mitogen, is a 34–45 kDa glycoprotein with a wide range of activities that include promotion of angiogenesis, enhancement of vascular-permeability and others. VEGF belongs to the platelet-derived growth factor (PDGF) family of growth factors with approximately 18% homology with the A and B chain of PDGF at the amino acid level. Additionally, VEGF contains the eight conserved cysteine residues common to all growth factors belonging to the PDGF family (Neufeld et al., supra). VEGF protein is believed to exist predominantly as disulfide-linked homodimers; monomers of VEGF have been shown to be inactive (Plouet et al., 1989 *EMBO J.* 8, 3801).

VEGF exerts its influence on vascular endothelial cells by binding to specific high-affinity cell surface receptors. Covalent cross-linking experiments with $^{125}$I-labeled VEGF protein have led to the identification of three high molecular weight complexes of 225, 195 and 175 kDa presumed to be VEGF and VEGF receptor complexes (Vaisman et al., 1990 *J. Biol. Chem.* 265, 19461). Based on these studies VEGF-specific receptors of 180, 150 and 130 kDa molecular mass were predicted. In endothelial cells, receptors of 150 and the 130 kDa have been identified. The VEGF receptors belong to the superfamily of receptor tyrosine kinases (RTKs) characterized by a conserved cytoplasmic catalytic kinase domain and a hydrophylic kinase sequence. The extracellular domains of the VEGF receptors consist of seven immunoglobulin-like domains that are thought to be involved in VEGF binding functions.

The two most abundant and high-affinity receptors of VEGF are flt-1 (fms-like tyrosine kinase) cloned by Shibuya et al., 1990 *Oncogene* 5, 519 and KDR (kinase-insert-domain-containing receptor) cloned by Terman et al., 1991 *Oncogene* 6, 1677. The murine homolog of KDR, cloned by Mathews et al., 1991, *Proc. Natl. Acad. Sci.,* USA, 88, 9026, shares 85% amino acid homology with KDR and is termed as flk-1 (fetal liver kinase-1). Recently it has been shown that the high-affinity binding of VEGF to its receptors is modulated by cell surface-associated heparin and heparin-like molecules (Gitay-Goren et al, 1992 *J. Biol. Chem.* 267, 6093).

VEGF expression has been associated with several pathological states such as tumor angiogenesis, several forms of blindness, rheumatoid arthritis, psoriasis and others. Following is a brief summary of evidence supporting the involvement of VEGF in various diseases:

1) Tumor angiogenesis: Increased levels of VEGF gene expression have been reported in vascularized and edema-associated brain tumors (Berkman et al., 1993 *J. Clini. Invest.* 91, 153). A more direct demostration of the role of VEGF in tumor angiogenesis was demonstrated by Jim Kim et al., 1993 *Nature* 362,841 wherein, monoclonal antibodies against VEGF were successfully used to inhibit the growth of rhabdomyosarcoma, glioblastoma multiforme cells in nude mice. Similarly, expression of a dominant negative mutated form of the flt-1 VEGF receptor inhibits vascularization induced by human glioblastoma cells in nude mice (Millauer et al., 1994, *Nature* 367, 576).

2) Ocular diseses: Aiello et al., 1994 *New Engl. J. Med.* 331, 1480, showed that the ocular fluid, of a majority of patients suffering from diabetic retinopathy and other retinal disorders, contains a high concentration of VEGF. Miller et al., 1994 *Am. J. Pathol.* 145, 574, reported elevated levels of VEGF mRNA in patients suffering from retinal ischemia. These observations support a direct role for VEGF in ocular diseases.

3) Psoriasis: Detmar et al., 1994 *J. Exp. Med.* 180, 1141 reported that VEGF and its receptors were over-expressed in psoriatic skin and psoriatic dermal microvessels, suggesting that VEGF plays a significant role in psoriasis.

4) Rheumatoid arthritis: Immunohistochemistry and in situ hybridization studies on tissues from the joints of patients suffering from rheumatoid arthritis show an increased level of VEGF and its receptors (Fava et al., 1994 *J. Exp. Med.* 180, 341). Additionally, Koch et al., 1994 *J. Immunol.* 152, 4149, found that VEGF-specific antibodies were able to significantly reduce the mitogenic activity of synovial tissues from patients suffering from rheumatoid arthritis. These observations support a direct role for VEGF in rheumatoid arthritis.

In addition to the above data on pathological conditions involving excessive angiogenesis, a number of studies have demonstrated that VEGF is both necessary and sufficient for neovascularization. Takashita et al., 1995 *J. Clin. Invest.* 93, 662, demonstrated that a single injection of VEGF augmented collateral vessel development in a rabbit model of ischemia. VEGF also can induce neovascularization when injected into the cornea. Expression of the VEGF gene in CHO cells is sufficient to confer tumorigenic potential to the cells. Kim et al., supra and Millauer et al., supra used monoclonal antibodies against VEGF or a dominant negative form of flk-1 receptor to inhibit tumor-induced neovascularization.

During development, VEGF and its receptors are associated with regions of new vascular growth (Millauer et al., 1993 *Cell* 72, 835; Shalaby et al., 1993 *J. Clin. Invest.* 91, 2235). Furthermore, transgenic mice lacking either of the VEGF receptors are defective in blood vessel formation, infact these mouse do not survive; flk-1 appears to be required for differentiation of endothelial cells, while flt-1 appears to be required at later stages of vessel formation (Shalaby et al., 1995 Nature 376, 62; Fung et al., 1995 Nature 376, 66). Thus, these receptors must be present to properly signal endothelial cells or their precursors to respond to vascularization-promoting stimuli.

All of the conditions listed above, involve extensive vascularization. This hyper-stimulation of endothelial cells may be alleviated by VEGF antagonists. Thus most of the therapeutic efforts for the above conditions have concentrated on finding inhibitors of the VEGF protein.

Kim et al., 1993 Nature 362, 841 have been successful in inhibiting VEGF-induced tumor growth and angiogenesis in nude mice by treating the mice with VEGF-specific monoclonal antibody.

Koch et al., 1994 J. Immunol. 152, 4149 showed that the mitogenic activity of microvascular endothelial cells found in rheumatoid arthritis (RA) synovial tissue explants and the chemotactic property of endothelial cells from RA synovial fluid can be neutralized significantly by treatment with VEGF-specific antibodies.

Ullrich et al., International PCT Publication No. WO 94/11499 and Millauer et al., 1994 Nature 367, 576 used a soluble form of flk-1 receptor (dominant-negative mutant) to prevent VEGF-mediated tumor angiogenesis in immunodeficient mice.

Kendall and Thomas, International PCT Publication No. WO 94/21679 describe the use of naturally occuring or recombinantly-engineered soluble forms of VEGF receptors to inhibit VEGF activity.

Robinson, International PCT Publication No. WO 95/04142 describes the use of antisense oligonucleotides targeted against VEGF RNA to inhibit VEGF expression.

Jellinek et al., 1994 Biochemistry 33, 10450 describe the use of VEGF-specific high-affinity RNA aptamers to inhibit the binding of VEGF to its receptors.

Rockwell and Goldstein, International PCT Publication No. WO 95/21868, describe the use of anti-VEGF receptor monoclonal antibodies to neutralize the the effect of VEGF on endothelial cells.

SUMMARY OF THE INVENTION

The invention features novel nucleic acid-based techniques [e.g., enzymatic nucleic acid molecules (ribozymes), antisense nucleic acids, 2–5A antisense chimeras, triplex DNA, antisense nucleic acids containing RNA cleaving chemical groups (Cook et al., U.S. Pat. No. 5,359,051)] and methods for their use to down regulate or inhibit the expression of receptors of VEGF (VEGF-R).

In a preferred embodiment, the invention features use of one or more of the nucleic acid-based techniques to inhibit the expression of flt-1 and/or flk-1 /KDR receptors.

By "inhibit" it is meant that the activity of VEGF-R or level of mRNAs or equivalent RNAs encoding VEGF-R is reduced below that observed in the absence of the nucleic acid. In one embodiment, inhibition with ribozymes preferably is below that level observed in the presence of an enzymatically inactive RNA molecule that is able to bind to the same site on the mRNA, but is unable to cleave that RNA. In another embodiment, inhibition with antisense oligonucleotides is preferably below that level observed in the presence of for example, an oligonucleotide with scrambled sequence or with mismatches.

By "enzymatic nucleic acid molecule" it is meant an RNA molecule which has complementarity in a substrate binding region to a specified gene target, and also has an enzymatic activity which is active to specifically cleave target RNA. That is, the enzymatic RNA molecule is able to intermolecularly cleave RNA and thereby inactivate a target RNA molecule. This complementary regions allow sufficient hybridization of the enzymatic RNA molecule to the target RNA and thus permit cleavage. One hundred percent complementarity is preferred, but complementarity as low as 50–75% may also be useful in this invention. By "equivalent" RNA to VEGF-R is meant to include those naturally occurring RNA molecules in various animals, including human, mice, rats, rabbits, primates and pigs.

By "antisense nucleic acid" it is meant a non-enzymatic nucleic acid molecule that binds to target RNA by means of RNA-RNA or RNA-DNA or RNA-PNA (protein nucleic acid; Egholm et al., 1993 Nature 365, 566) interactions and alters the activity of the target RNA (for a review see Stein and Cheng, 1993 Science 261, 1004).

By "2–5A antisense chimera" it is meant, an antisense oligonucleotide containing a 5' phosphorylated 2'-5'-linked adenylate residues. These chimeras bind to target RNA in a sequence-specific manner and activate a cellular 2–5A-dependent ribonuclease which, in turn, cleaves the target RNA (Torrence et al., 1993 Proc. Natl. Acad. Sci. USA 90, 1300).

By "triplex DNA" it is meant an oligonucleotide that can bind to a double-stranded DNA in a sequence-specific manner to form a triple-strand helix. Formation of such triple helix structure has been shown to inhibit transcription of the targeted gene (Duval-Valentin et al., 1992 Proc. Natl. Acad. Sci. USA 89, 504).

By "gene" it is meant a nucleic acid that encodes an RNA.

By "complementarity" it is meant a nucleic acid that can form hydrogen bond(s) with other RNA sequence by either traditional Watson-Crick or other non-traditional types (for example, Hoogsteen type) of base-paired interactions.

Six basic varieties of naturally-occurring enzymatic RNAs are known presently. Each can catalyze the hydrolysis of RNA phosphodiester bonds in trans (and thus can cleave other RNA molecules) under physiological conditions. Table I summarizes some of the characteristics of these ribozymes. In general, enzymatic nucleic acids act by first binding to a target RNA. Such binding occurs through the target binding portion of a enzymatic nucleic acid which is held in close proximity to an enzymatic portion of the molecule that acts to cleave the target RNA. Thus, the enzymatic nucleic acid first recognizes and then binds a target RNA through complementary base-pairing, and once bound to the correct site, acts enzymatically to cut the target RNA. Strategic cleavage of such a target RNA will destroy its ability to direct synthesis of an encoded protein. After an enzymatic nucleic acid has bound and cleaved its RNA target, it is released from that RNA to search for another target and can repeatedly bind and cleave new targets. Thus, a single ribozyme molecule is able to cleave many molecules of target RNA. In addition, the ribozyme is a highly specific inhibitor of gene expression, with the specificity of inhibition depending not only on the base-pairing mechanism of binding to the target RNA, but also on the mechanism of target RNA cleavage. Single mismatches, or base-substitutions, near the site of cleavage can completely eliminate catalytic activity of a ribozyme.

Ribozymes that cleave the specified sites in VEGF-R mRNAs represent a novel therapeutic approach to treat tumor angiogenesis, ocular diseases, rhuematoid arthritis, psoriasis and others. Applicant indicates that ribozymes are able to inhibit the activity of VEGF-R (specifically flt-1 and flk-1/KDR) and that the catalytic activity of the ribozymes is required for their inhibitory effect. Those of ordinary skill in the art will find that it is clear from the examples described that other ribozymes that cleave VEGF-R mRNAs may be readily designed and are within the invention.

In preferred embodiments of this invention, the enzymatic nucleic acid molecule is formed in a hammerhead or hairpin motif, but may also be formed in the motif of a hepatitis delta virus, group I intron or RNaseP RNA (in association with an RNA guide sequence) or Neurospora VS RNA. Examples of such hammerhead motifs are described by Rossi et al., 1992, *AIDS Research and Human Retroviruses* 8, 183, of hairpin motifs by Hampel et al., EP0360257, Hampel and Tritz, 1989 *Biochemistry* 28, 4929, and Hampel et al., 1990 *Nucleic Acids Res.* 18, 299, and an example of the hepatitis delta virus motif is described by Perrotta and Been, 1992 *Biochemistry* 31, 16; of the RNaseP motif by Guerrier-Takada et al., 1983 *Cell* 35, 849, Neurospora VS RNA ribozyme motif is described by Collins (Saville and Collins, 1990 *Cell* 61, 685–696; Saville and Collins, 1991 *Proc. Natl. Acad. Sci. USA* 88, 8826–8830; Collins and Olive, 1993 *Biochemistry* 32, 2795–2799) and of the Group I intron by Cech et al., U.S. Pat. No. 4,987,071. These specific motifs are not limiting in the invention and those skilled in the art will recognize that all that is important in an enzymatic nucleic acid molecule of this invention is that it has a specific substrate binding site which is complementary to one or more of the target gene RNA regions, and that it have nucleotide sequences within or surrounding that substrate binding site which impart an RNA cleaving activity to the molecule.

In a preferred embodiment the invention provides a method for producing a class of enzymatic cleaving agents which exhibit a high degree of specificity for the RNA of a desired target. The enzymatic nucleic acid molecule is preferably targeted to a highly conserved sequence region of target mRNAs encoding VEGF-R proteins (specifically flt-1 and flk-1/KDR) such that specific treatment of a disease or condition can be provided with either one or several enzymatic nucleic acids. Such enzymatic nucleic acid molecules can be delivered exogenously to specific tissue or cellular targets as required. Alternatively, the ribozymes can be expressed from DNA and/or RNA vectors that are delivered to specific cells.

Synthesis of nucleic acids greater than 100 nucleotides in length is difficult using automated methods, and the therapeutic cost of such molecules is prohibitive. In this invention, small nucleic acid motifs (e.g., antisense oligonucleotides, hammerhead or the hairpin ribozymes) are used for exogenous delivery. The simple structure of these molecules increases the ability of the nucleic acid to invade targeted regions of the mRNA structure. However, these nucleic acid molecules can also be expressed within cells from eukaryotic promoters (e.g., Izant and Weintraub, 1985 *Science* 229, 345; McGarry and Lindquist, 1986 *Proc. Natl. Acad. Sci. USA* 83, 399; SullengerScanlon et al., 1991, *Proc. Natl. Acad. Sci. USA,* 88, 10591–5; Kashani-Sabet et al., 1992 *Antisense Res. Dev.,* 2, 3–15; Dropulic et al., 1992 *J. Virol,* 66, 1432–41; Weerasinghe et al., 1991 *J. Virol,* 65, 5531–4; Ojwang et al., 1992 *Proc. Natl. Acad. Sci. USA* 89, 10802–6; Chen et al., 1992 *Nucleic Acids Res.,* 20, 4581–9; Sarver et al., 1990 *Science* 247, 1222–1225; Thompson et al., 1995 *Nucleic Acids Res.* 23, 2259). Those skilled in the art realize that any nucleic acid can be expressed in eukaryotic cells from the appropriate DNA/RNA vector. The activity of such nucleic acids can be augmented by their release from the primary transcript by a ribozyme (Draper et al., PCT WO93/23569, and Sullivan et al., PCT WO94/02595, both hereby incorporated in their totality by reference herein; Ohkawa et al., 1992 *Nucleic Acids Symp. Ser.,* 27, 15–6; Taira et al., 1991, *Nucleic Acids Res.,* 19, 5125–30; Ventura et al., 1993 *Nucleic Acids Res.,* 21, 3249–55; Chowrira et al., 1994 *J. Biol. Chem.* 269, 25856).

Such nucleic acids are useful for the prevention of the diseases and conditions discussed above, and any other diseases or conditions that are related to the levels of VEGF-R (specifically flt-1 and flk-1/KDR) in a cell or tissue.

By "related" is meant that the reduction of VEGF-R (specifically flt-1 and flk-1/KDR) RNA levels and thus reduction in the level of the respective protein will relieve, to some extent, the symptoms of the disease or condition.

Ribozymes are added directly, or can be complexed with cationic lipids, packaged within liposomes, or otherwise delivered to target cells or tissues. The nucleic acid or nucleic acid complexes can be locally administered to relevant tissues ex vivo, or in vivo through injection, infusion pump or stent, with or without their incorporation in biopolymers. In preferred embodiments, the ribozymes have binding arms which are complementary to the sequences in Tables II to IX. Examples of such ribozymes also are shown in Tables II to IX. Examples of such ribozymes consist essentially of sequences defined in these Tables. By "consists essentially of" is meant that the active ribozyme contains an enzymatic center equivalent to those in the examples, and binding arms able to bind mRNA such that cleavage at the target site occurs. Other sequences may be present which do not interfere with such cleavage.

In another aspect of the invention, ribozymes that cleave target RNA molecules and inhibit VEGF-R (specifically flt-1 and flk-1/KDR) activity are expressed from transcription units inserted into DNA or RNA vectors. The recombinant vectors are preferably DNA plasmids or viral vectors. Ribozyme expressing viral vectors could be constructed based on, but not limited to, adeno-associated virus, retrovirus, adenovirus, or alphavirus. Preferably, the recombinant vectors capable of expressing the ribozymes are delivered as described above, and persist in target cells. Alternatively, viral vectors may be used that provide for transient expression of ribozymes. Such vectors might be repeatedly administered as necessary. Once expressed, the ribozymes cleave the target mRNA. Delivery of ribozyme expressing vectors could be systemic, such as by intravenous or intramuscular administration, by administration to target cells ex-planted from the patient followed by reintroduction into the patient, or by any other means that would allow for introduction into the desired target cell.

By "vectors" is meant any nucleic acid- and/or viral-based technique used to deliver a desired nucleic acid.

Other features and advantages of the invention will be apparent from the following description of the preferred embodiments thereof, and from the claims.

DESCRIPTION OF THE PREFERRED EMBODIMENTS

First the drawings will be described briefly.

DRAWINGS

FIG. 1 is a diagrammatic representation of the hammerhead ribozyme domain known in the art. Stem II can be $\geq 2$ base-pair long.

FIGS. 2a–2d: is a diagrammatic representation of the hammerhead ribozyme domain known in the art; FIG. 2b is a diagrammatic representation of the hammerhead ribozyme as divided by Uhlenbeck (1987, *Nature*, 327, 596–600) into a substrate and enzyme portion; FIG. 2c is a similar diagram showing the hammerhead divided by Haseloff and Gerlach (1988, *Nature*, 334, 585–591) into two portions; and FIG. 2d is a similar diagram showing the hammerhead divided by Jeffries and Symons (1989, *Nucl. Acids. Res.*, 17, 1371–1371) into two portions.

FIG. 3 is a diagramatic representation of the general structure of a hairpin ribozyme. Helix 2 (H2) is provided with a least 4 base pairs (i.e., n is 1, 2, 3 or 4) and helix 5 can be optionally provided of length 2 or more bases (preferably 3–20 bases, i.e., m is from 1–20 or more). Helix 2 and helix 5 may be covalently linked by one or more bases (i.e., r is ≧1 base). Helix 1, 4 or 5 may also be extended by 2 or more base pairs (e.g., 4–20 base pairs) to stabilize the ribozyme structure, and preferably is a protein binding site. In each instance, each N and N' independently is any normal or modified base and each dash represents a potential base-pairing interaction. These nucleotides may be modified at the sugar, base or phosphate. Complete base-pairing is not required in the helices, but is preferred. Helix 1 and 4 can be of any size (i.e., o and p is each independently from 0 to any number, e.g., 20) as long as some base-pairing is maintained. Essential bases are shown as specific bases in the structure, but those in the art will recognize that one or more may be modified chemically (abasic, base, sugar and/or phosphate modifications) or replaced with another base without significant effect. Helix 4 can be formed from two separate molecules, i.e., without a connecting loop. The connecting loop when present may be a ribonucleotide with or without modifications to its base, sugar or phosphate. "q" is ≧2 bases. The connecting loop can also be replaced with a non-nucleotide linker molecule. H refers to bases A, U, or C. Y refers to pyrimidine bases. "_" refers to a covalent bond.

FIG. 6 is a schematic representation of an RNAseH accessibility assay. Specifically, the left side of FIG. 6 is a diagram of complementary DNA oligonucleotides bound to accessible sites on the target RNA. Complementary DNA oligonucleotides are represented by broad lines labeled A, B, and C. Target RNA is represented by the thin, twisted line. The right side of FIG. 6 is a schematic of a gel separation of uncut target RNA from a cleaved target RNA. Detection of target RNA is by autoradiography of body-labeled, T7 transcript. The bands common to each lane represent uncleaved target RNA; the bands unique to each lane represent the cleaved products.

Figure 7:
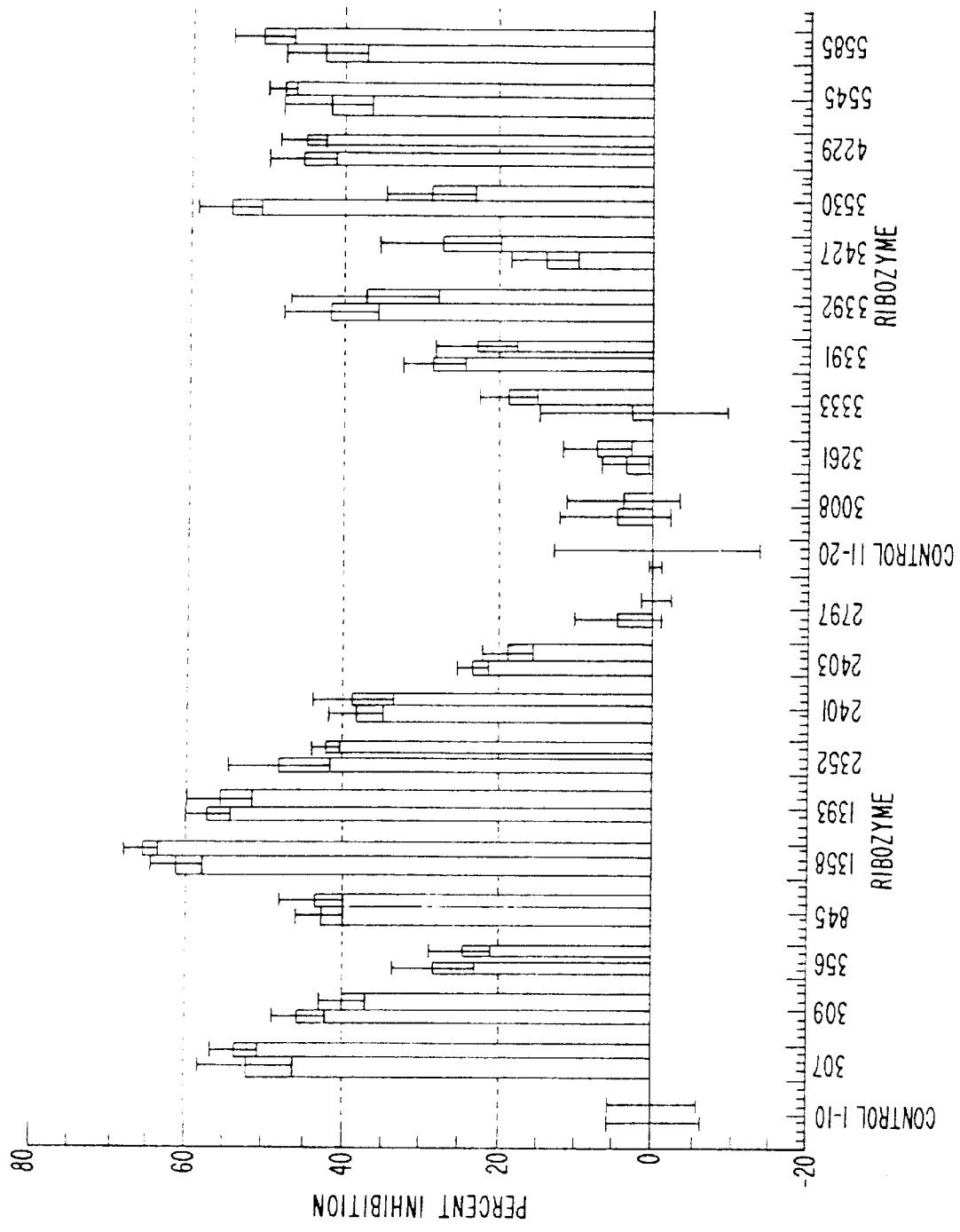

FIG. 7 shows the effect of hammerhead ribozymes targeted against flt-1 receptor on the binding of VEGF to the surface of human microvascular endothelial cells. Sequences of the ribozymes used are shown in Table II; the length of stem II region is 3 bp. The hammerhead ribozymes were chemically modified such that the ribozyme consists of ribose residues at five positions (see FIG. 11); U4 and U7 positions contain 2'-NH$_2$ modifications, the remaining nucleotide positions contain 2'-O-methyl substitutions; four nucleotides at the 5' terminus contains phosphorothioate substitutions. Additionally, the 3' end of the ribozyme contains a 3'-3' linked inverted abasic deoxyribose. The results of two separate experiments are shown as separate bars for each set. Each bar represents the average of triplicate samples. The standard deviation is shown with error bars. For the flt-1 data, 500 nM ribozyme (3:1 charge ratio with LipofectAMINE®) was used. Control 1–10 is the control for ribozymes 307–2797, control 11–20 is the control for ribozymes 3008–5585. The Control 1–10 and Control 11–20 represent the treatment of cells with LipofectAMINE® alone without any ribozymes.

Figure 8:
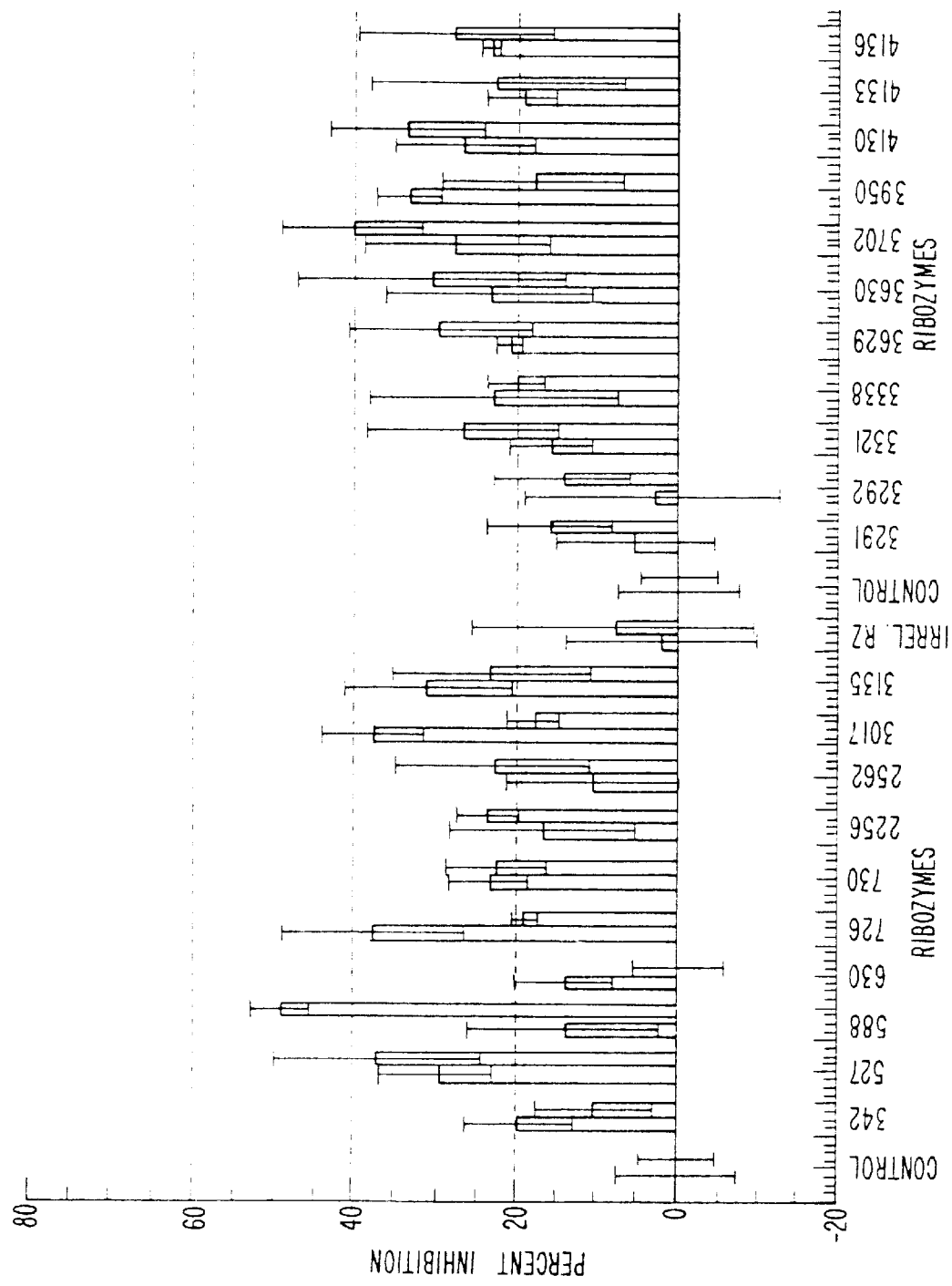

FIG. 8 shows the effect of hammerhead ribozymes targeted against KDR receptor on the binding of VEGF to KDR on the surface of human microvascular endothelial cells. Sequences of the ribozymes used are shown in Table IV; the length of stem II region is 3 bp. The hammerhead ribozymes were chemically modified such that the ribozyme consists of ribose residues at five positions (see FIG. 11); U4 and U7 positions contain 2'-NH$_2$ modifications, the remaining nucleotide positions contain 2'-O-methyl substitutions; four nucleotides at the 5' terminus contains phosphorothioate substitutions. Additionally, the 3' end of the ribozyme contains a 3'-3' linked inverted abasic deoxyribose. The Control 1–10 and Control 11–20 represent the treatment of cells with LipofectAMINE® alone without any ribozymes. Irrel. RZ, is a control experiment wherein the cells are treated with a non-KDR-targeted ribozyme complexed with Lipofectamine®. 200 nM ribozyme (3:1 charge ratio with LipofectAMINE(®) was used. In addition to the KDR-targeted ribozymes, the effect on VEGF binding of a ribozyme targeted to an irrelevant mRNA (irrel. RZ) is also shown. Because the affinity of KDR for VEGF is about 10-fold lower than the affinity of flt-1 for VEGF, a higher concentration of VEGF was used in the binding assay.

Figure 9:
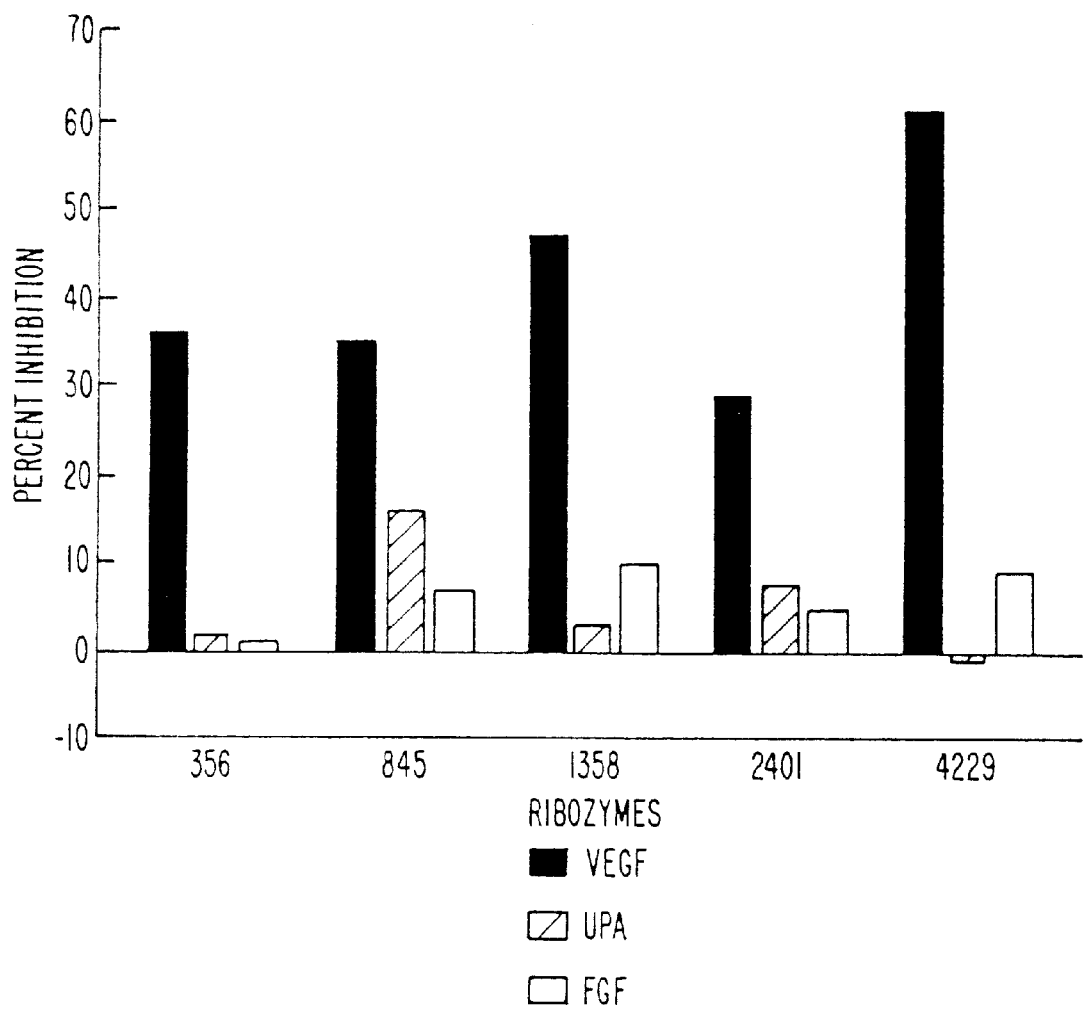

FIG. 9 shows the specificity of hammerhead ribozymes targeted against flt-1 receptor. Inhibition of the binding of VEGF, urokinase plasminogen activator (UPA) and fibroblast growth factor (FGF) to their corresponding receptors as a function of anti-FLT ribozymes is shown. The sequence and description of the ribozymes used are as described under FIG. 7 above. The average of triplicate samples is given; percent inhibition as calculated below.

FIG. 10 shows the inhibition of the proliferation of Human aortic endothelial cells (HAEC) mediated by phosphorothioate antisense oligodeoxynucleotides targeted against human KDR receptor RNA. Cell proliferation (O.D. 490) as a function of antisense oligodeoxynucleotide concentration is shown. KDR 21AS represents a 21 nt phosphorothioate antisense oligodeoxynucleotide targeted against KDR RNA. KDR 21 Scram represents a 21 nt phosphorothioate oligodeoxynucleotide having a scrambled sequence. LF represents the lipid carrier Lipofectin.

FIGS. 11 A–C show in vitro cleavage of flt-1 RNA by hammerhead ribozymes. A) diagrammatic representation of hammerhead ribozymes targeted against flt-1 RNA. The hammerhead (HH) ribozymes were chemically modified such that the ribozyme consists of ribose residues at five positions; U4 and U7 positions contain 2'-NH$_2$ modifications, the remaining nucleotide positions contain 2'-O-methyl substitutions; four nucleotides at the 5' terminus contains phosphorothioate substitutions. Additionally, the 3' end of the ribozyme contains a 3'-3' linked inverted abasic deoxyribose (designated as 3'-iH). 1358 HH-A and 4229 HH-A contain 3 base-paired stem 11 region. 1358 HH-B and 4229 HH-B contain 4 base-paired stem II region. B) and C) shows in vitro cleavage kinetics of HH ribozymes targeted against sites 1358 and 4229 within the flt-1 RNA.

FIGS. 12 A–B show inhibition of human microvascular endothelial cell proliferation mediated by anti-flt-1 hammerhead ribozymes. A) Diagrammatic representation of hammerhead (HH) ribozymes targeted against sites 1358 and 4229 within the the flt-1 RNA. B) Graphical representation of the inhibition of cell proliferation mediated by 1358HH and 4229HH ribozymes.

Figure 13:
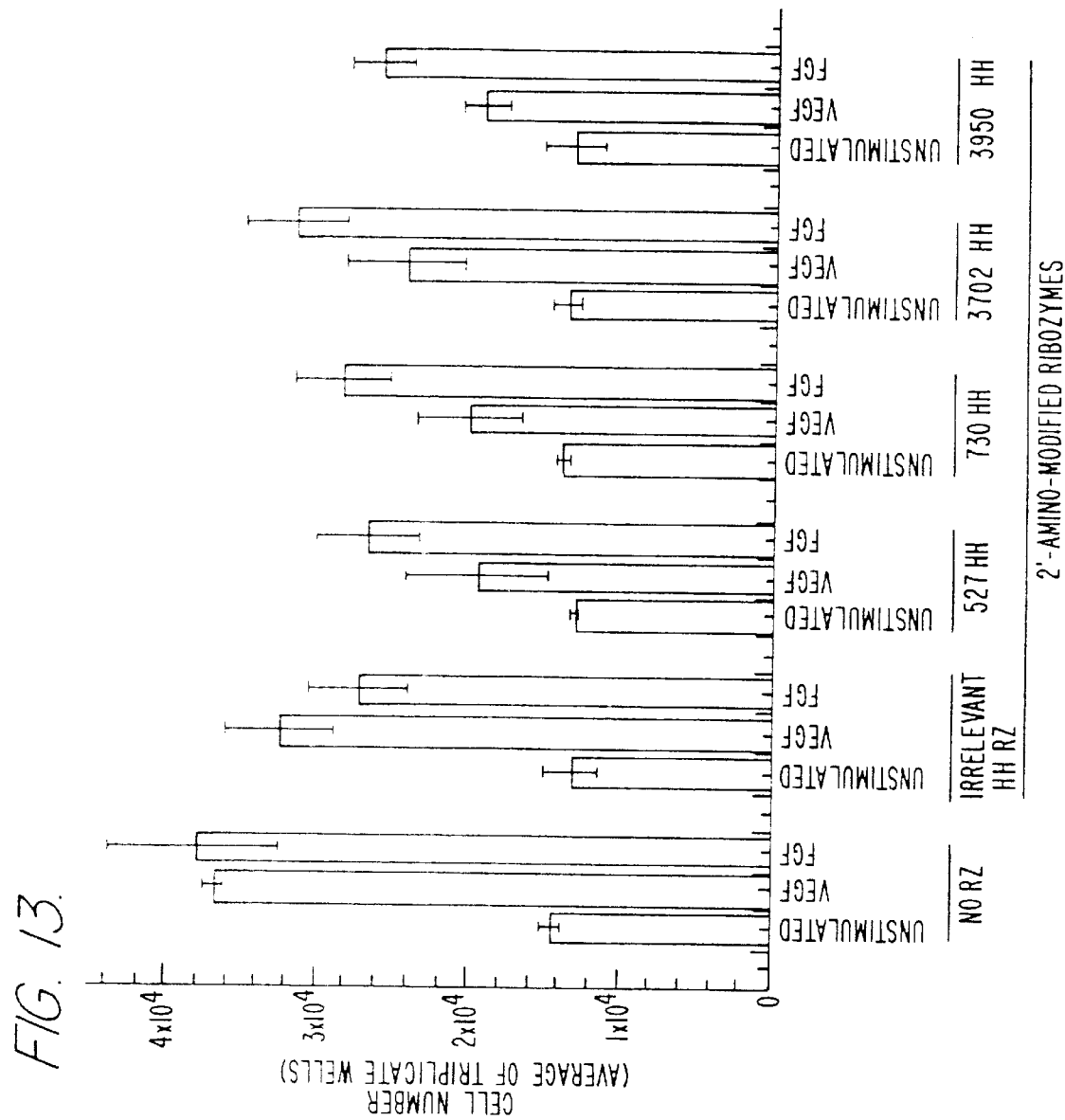

FIG. 13 shows inhibition of human microvascular endothelial cell proliferation mediated by anti-KDR hammerhead ribozymes. The figure is a graphical representation of the inhibition of cell proliferation mediated by hammerhead ribozymes targeted against sites 527, 730, 3702 and 3950 within the KDR RNA. Irrelevant HH RZ is a hammerhead ribozyme targeted to an irrelevant target. All of these ribozymes, including the Irrelevant HH RZ, were chemically modified such that the ribozyme consists of ribose residues at five positions; U4 and U7 positions contain 2'-NH$_2$ modifications, the remaining nucleotide positions contain 2'-O-methyl substitutions; four nucleotides at the 5' termini contain phosphorothioate substitutions. Additionally, the 3' end of the ribozyme contains a 3'-3' linked inverted abasic deoxyribose (3'-iH).

Figure 14:
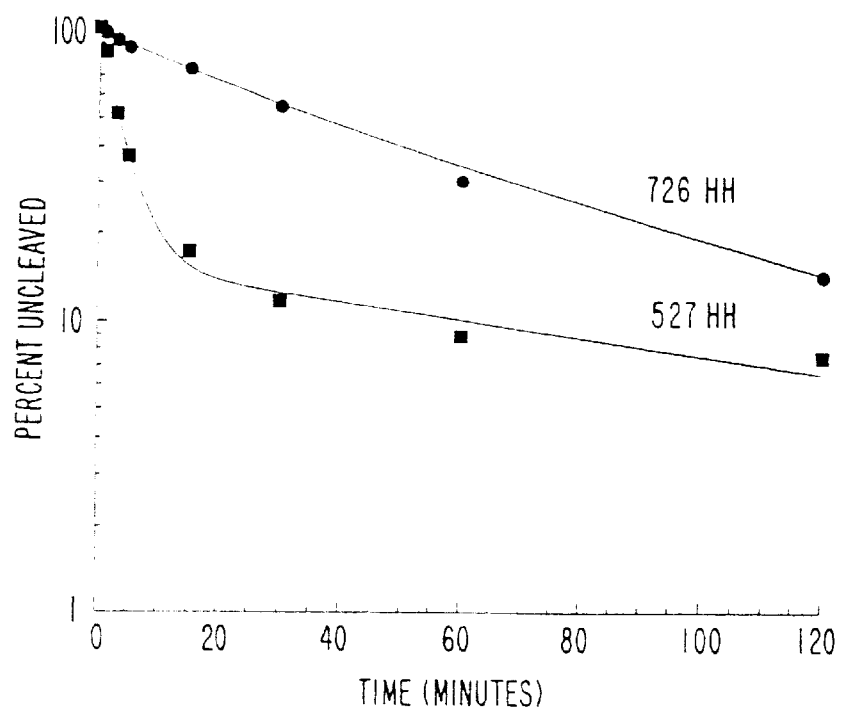

FIG. 14 shows in vitro cleavage of KDR RNA by hammerhead ribozymes. The hammerhead (HH) ribozymes were chemically modified such that the ribozyme consists of ribose residues at five positions; U4 and U7 positions contain 2'-NH$_2$ modifications, the remaining nucleotide positions contain 2'-O-methyl substitutions. Additionally, the 3' end of the ribozyme contains a 3'-3' linked inverted abasic deoxyribose (designated as 3'-iH). 726 HH and 527 HH contain 4 base-paired stem II region. Percentin vitro cleavage kinetics as a function of time of HH ribozymes targeted against sites 527 and 726 within the KDR RNA is shown.

Figure 15:
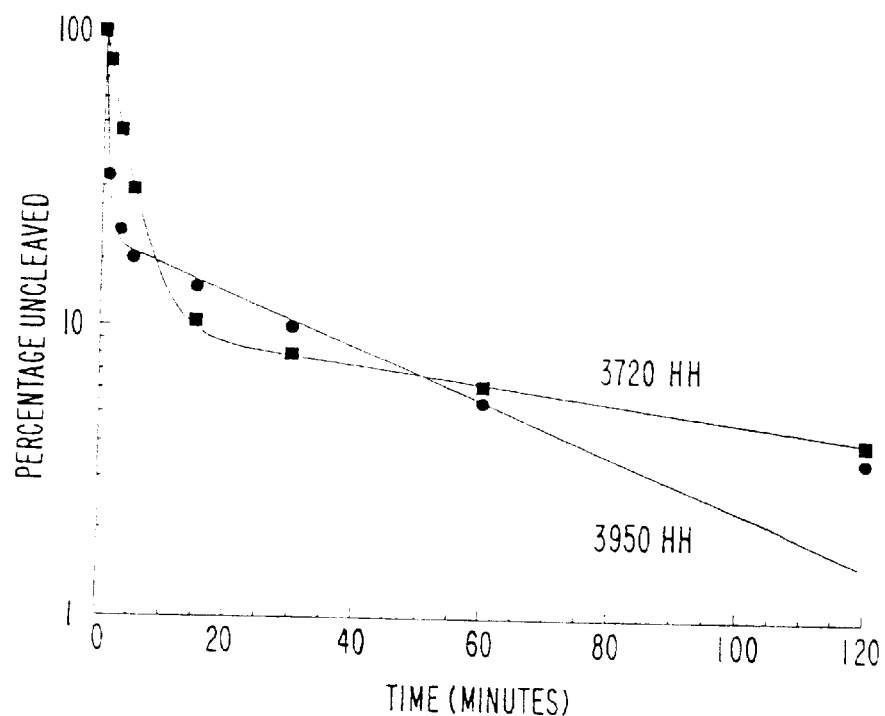

FIG. 15 shows in vitro cleavage of KDR RNA by hammerhead ribozymes. The hammerhead (HH) ribozymes were chemically modified such that the ribozyme consists of ribose residues at five positions; U4 and U7 positions contain 2'-NH$_2$ modifications, the remaining nucleotide positions contain 2'-O-methyl substitutions. Additionally, the 3' end of the ribozyme contains a 3'-3' linked inverted abasic deoxyribose (designated as 3'-iH). 3702 HH and 3950 HH contain 4 base-paired stem II region. Percentin vitro cleavage kinetics as a function of time of HH ribozymes targeted against sites 3702 and 3950 within the KDR RNA is shown.

Figure 16:
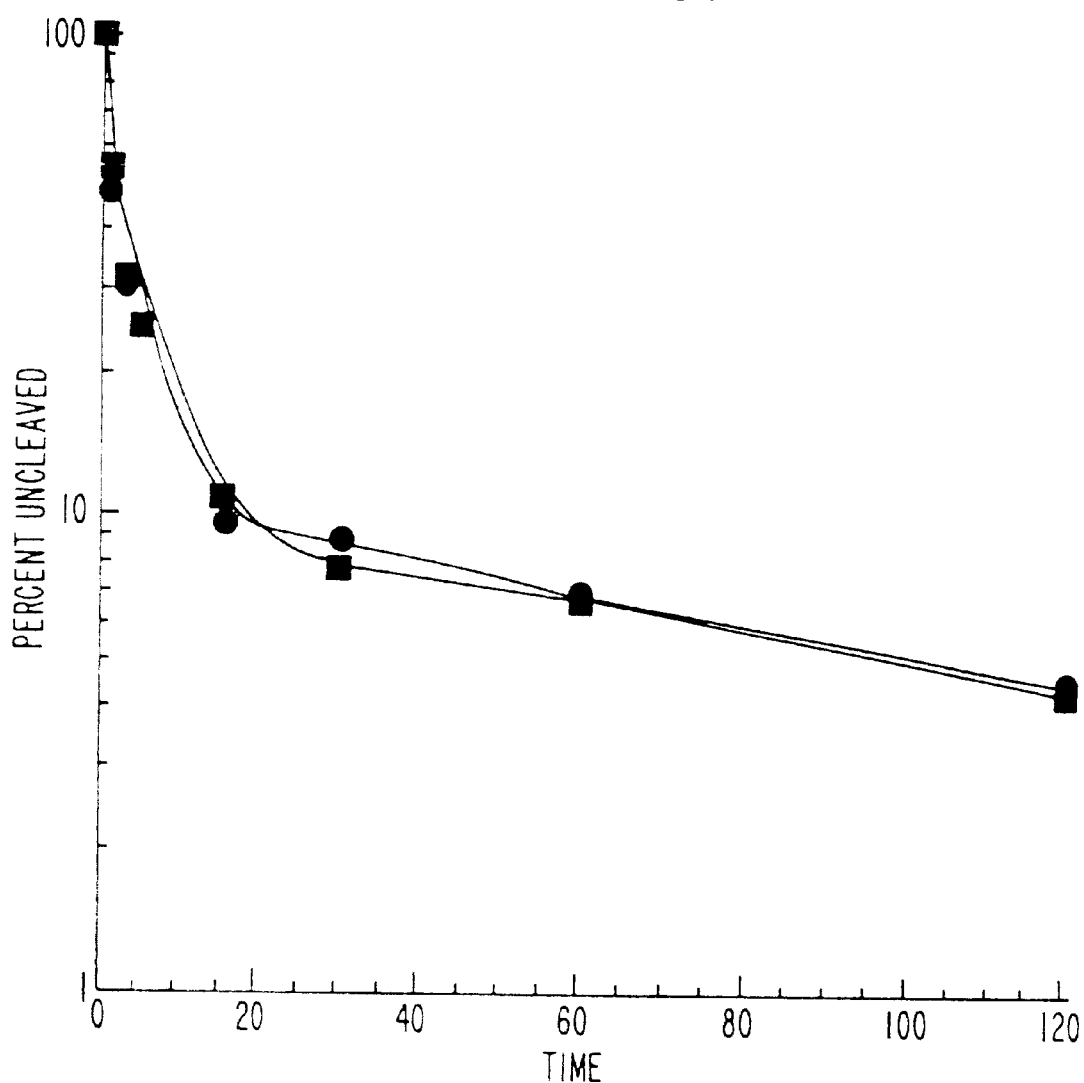

FIG. 16 shows in vitro cleavage of RNA by hammerhead ribozymes that are targeted to sites that are conserved between flt-1 and KDR RNA. The hammerhead (HH) ribozymes were chemically modified such that the ribozyme consists of ribose residues at five positions; U4 and U7 positions contain 2'-NH$_2$ modifications, the remaining nucleotide positions contain 2'-O-methyl substitutions. Additionally, the 3'end of the ribozyme contains a 3'-3' linked inverted abasic deoxyribose (designated as 3'-iH). FLT/KDR-I HH ribozyme was synthesized with either a 4 base-paired or a 3 base-paired stem II region. FLT/KDR-I HH can cleave site 3388 within flt-1 RNA and site 3151 within KDR RNA. Percentin vitro cleavage kinetics as a function of time of HH ribozymes targeted against sites 3702 and 3950 within the KDR RNA is shown.

Figure 17:
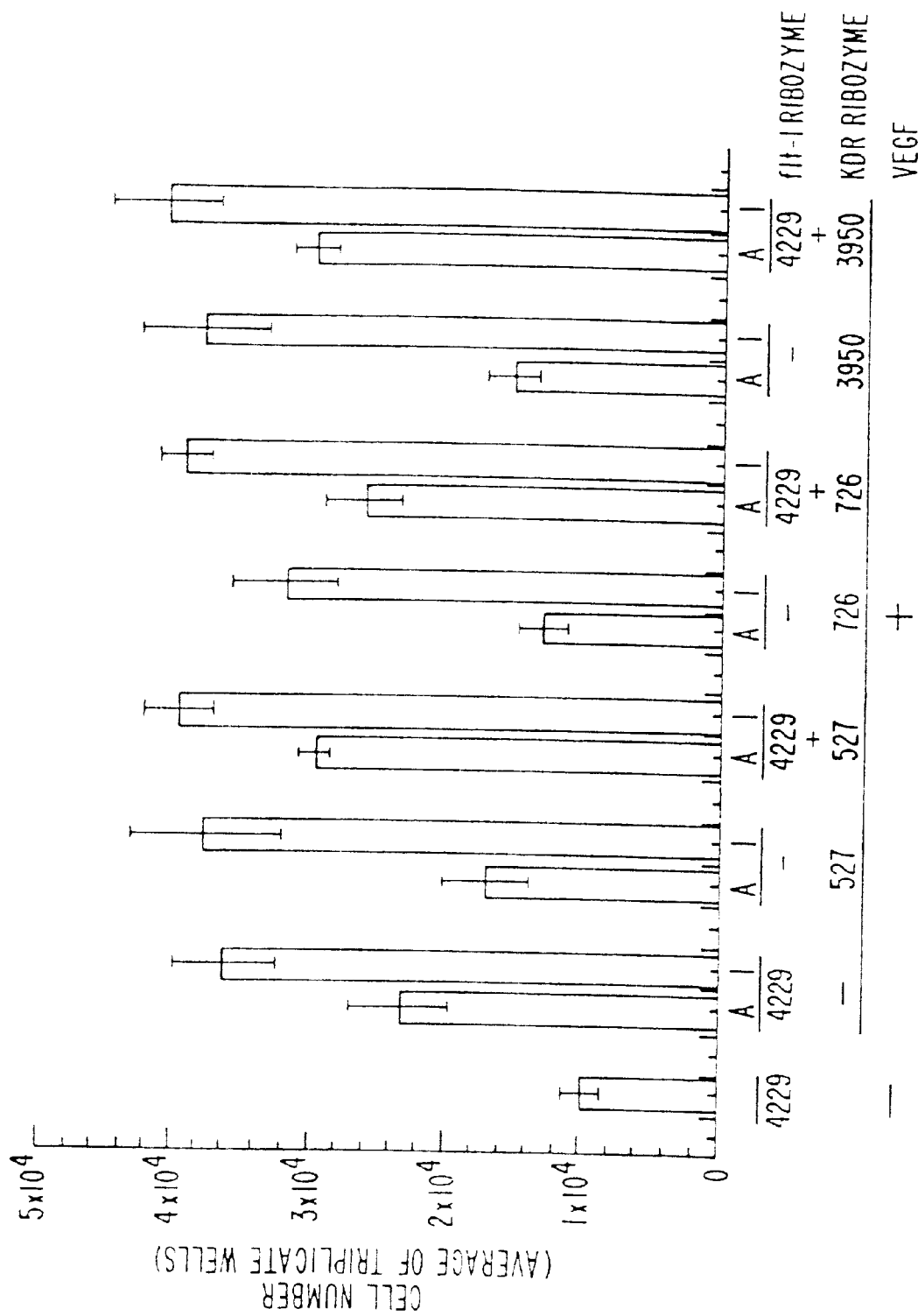

FIG. 17 shows inhibition of human microvascular endothelial cell proliferation mediated by anti-KDR and anti-flt-1 hammerhead ribozymes. The figure is a graphical representation of the inhibition of cell proliferation mediated by hammerhead ribozymes targeted against sites KDR sites-527, 726 or 3950 or flt-1 site 4229. The figure also shows enhanced inhibition of cell proliferation by a combination of flt-1 and KDR hammerhead ribozymes. 4229+527, indicates the treatment of cells with both the flt 4229 and the KDR 527 ribozymes. 4229+726, indicates the treatment of cells with both the flt 4229 and the KDR 726 ribozymes. 4229+3950, indicates the treatment of cells with both the flt 4229 and the KDR 3950 ribozymes. VEGF –, indicates the basal level of cell proliferation in the absence of VEGF. A, indicates catalytically active ribozyme; I, indicates catalytically inactive ribozyme. All of these ribozymes were chemically modified such that the ribozyme consists of ribose residues at five positions; U4 and U7 positions contain 2'-NH$_2$ modifications, the remaining nucleotide positions contain 2'-O-methyl substitutions; four nucleotides at the 5' termini contain phosphorothioate substitutions. Additionally, the 3' end of the ribozyme contains a 3'-3' linked inverted abasic deoxyribose (3'-iH).

Figure 18:
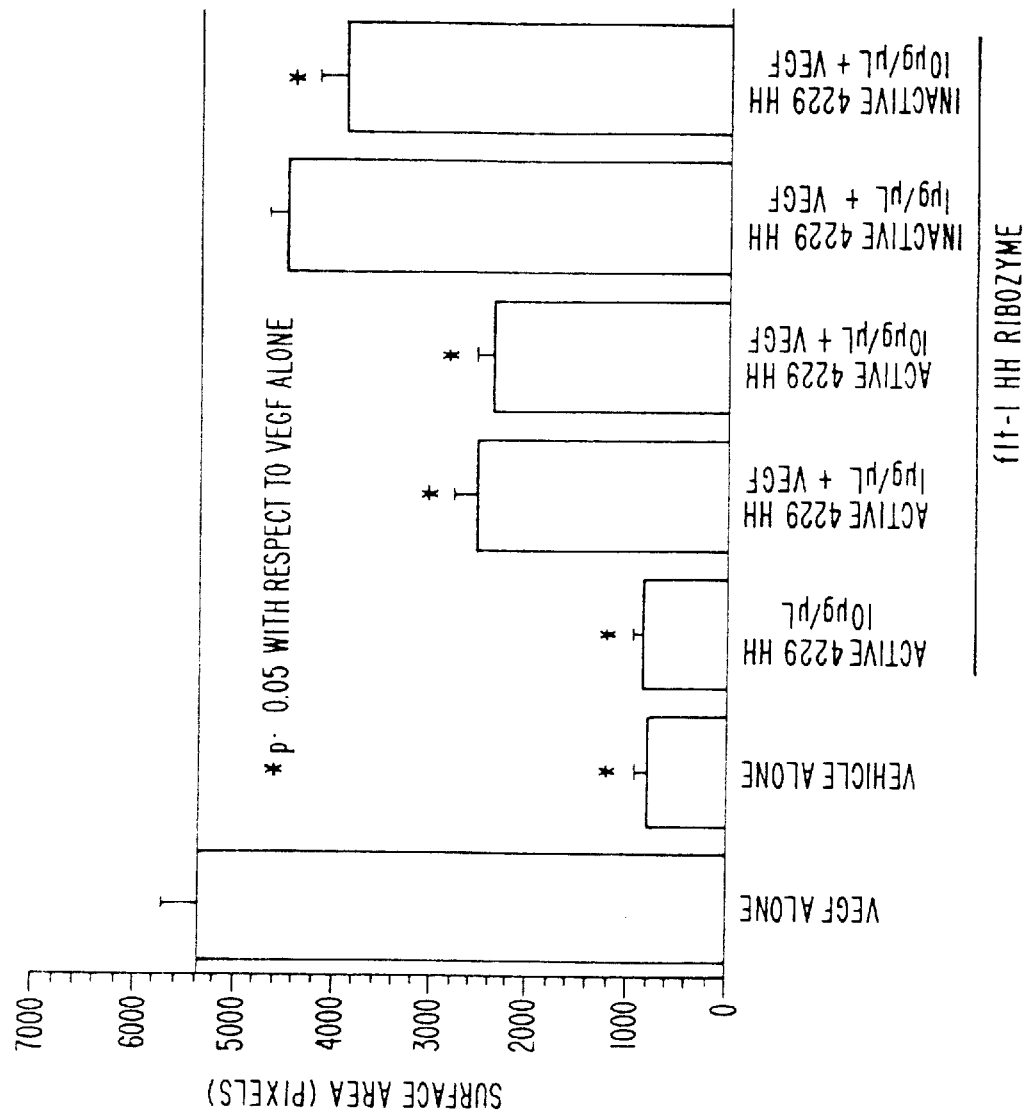

FIG. 18 shows the inhibition of VEGF-induced angiogenesis in rat cornea mediated by anti-flt-1 hammerhead ribozyme. All of these ribozymes were chemically modified such that the ribozyme consists of ribose residues at five positions; U4 position contains 2'-C-allyl modifications, the remaining nucleotide positions contain 2'-O-methyl substitutions; four nucleotides at the 5' termini contain phosphorothioate substitutions. Additionally, the 3' end of the ribozyme contains a 3'-3' linked inverted abasic deoxyribose (3'-iH). A decrease in the Surface Area corresponds to a reduction in angiogenesis. VEGF alone, corresponds to treatment of the cornea with VEGF and no ribozymes. Vehicle alone, corresponds to the treatment of the cornea with the carrier alone and no VEGF. This control gives a basal level of Surface Area. Active 4229 HH, corresponds to the treatment of cornea with the flt-1 4229 HH ribozyme in the absence of any VEGF. This control also gives a basal level of Surface Area. Active 4229 HH+VEGF, corresponds to the co-treatment of cornea with the flt-1 4229 HH ribozyme and VEGF. Inactive 4229 HH+VEGF, corresponds to the co-treatment of cornea with a catalytically inactive version of 4229 HH ribozyme and VEGF.

Ribozymes

Ribozymes of this invention block to some extent VEGF-R (specifically flt-1 and flk-1/KDR) production and can be used to treat disease or diagnose such disease. Ribozymes will be delivered to cells in culture, to cells or tissues in animal models of angiogenesis and/or RA and to human cells or tissues ex vivo or in vivo. Ribozyme cleavage of VEGF-R RNAs (specifically RNAs that encode flt-1 and flk-1/KDR) in these systems may alleviate disease symptoms.

Target Sites

Targets for useful ribozymes can be determined as disclosed in Draper et al., International PCT Publication No. WO 95/13380, and hereby incorporated by reference herein in totality. Other examples include the following PCT applications which concern inactivation of expression of disease-related genes: WO 95/23225, WO 95/13380, WO 94/02595, incorporated by reference herein. Rather than repeat the guidance provided in those documents here, below are provided specific examples of such methods, not limiting to those in the art. Ribozymes to such targets are designed as described in those applications and synthesized to be tested in vitro and in vivo, as also described.

The sequence of human and mouse flt-1, KDR and/or flk-1 mRNAs were screened for optimal ribozyme target sites using a computer folding algorithm. Hammerhead or hairpin ribozyme cleavage sites were identified. These sites are shown in Tables II to IX (all sequences are 5' to 3' in the tables; X can be any base-paired sequence, the actual sequence is not relevant here). The nucleotide base position is noted in the Tables as that site to be cleaved by the designated type of ribozyme. While mouse and human sequences can be screened and ribozymes thereafter designed, the human targeted sequences are of most utility. However, as discussed in Stinchcomb et al., "Method and Composition for Treatment of Restenosis and Cancer Using Ribozymes," filed May 18, 1994, U.S. Ser. No. 08/245,466, mouse targeted ribozymes may be useful to test efficacy of action of the ribozyme prior to testing in humans. The nucleotide base position is noted in the Tables as that site to be cleaved by the designated type of ribozyme.

Hammerhead or hairpin ribozymes were designed that could bind and cleave target RNA in a sequence-specific manner. The ribozymes were individually analyzed by computer folding (Jaeger et al., 1989 *Proc. Natl. Acad. Sci. USA*, 86, 7706) to assess whether the ribozyme sequences fold into the appropriate secondary structure. Those ribozymes with unfavorable intramolecular interactions between the binding arms and the catalytic core were eliminated from consideration. Varying binding arm lengths can be chosen to optimize activity.

Referring to FIG. 6, mRNA is screened for accessible cleavage sites by the method described generally in Draper et al., PCT WO93/23569, hereby incorporated by reference herein. Briefly, DNA oligonucleotides complementary to potential hammerhead or hairpin ribozyme cleavage sites were synthesized. A polymerase chain reaction is used to generate substrates for T7 RNA polymerase transcription from human and mouse flt-1, KDR and/or flk-1 cDNA clones. Labeled RNA transcripts are synthesized in vitro from the templates. The oligonucleotides and the labeled transcripts were annealed, RNAseH was added and the mixtures were incubated for the designated times at 37° C. Reactions are stopped and RNA separated on sequencing polyacrylamide gels. The percentage of the substrate cleaved is determined by autoradiographic quantitation using a PhosphorImaging system. From these data, hammerhead or hairpin ribozyme sites are chosen as the most accessible.

Ribozymes of the hammerhead or hairpin motif were designed to anneal to various sites in the mRNA message. The binding arms are complementary to the target site sequences described above. The ribozymes were chemically synthesized. The method of synthesis used follows the procedure for normal RNA synthesis as described in Usman et al., 1987 *J. Am. Chem. Soc.*, 109, 7845; Scaringe et al., 1990 *Nucleic Acids Res.*, 18, 5433; and Wincott et al., 1995 *Nucleic Acids Res.* 23, 2677–2684 and makes use of common nucleic acid protecting and coupling groups, such as dimethoxytrityl at the 5'-end, and phosphoramidites at the 3'-end. Small scale synthesis were conducted on a 394 Applied Biosystems, Inc. synthesizer using a modified 2.5 μmol scale protocol with a 5 min coupling step for alkylsilyl protected nucleotides and 2.5 min coupling step for 2'-O-methylated nucleotides. Table XI outlines the amounts, and the contact times, of the reagents used in the synthesis cycle. A 6.5-fold excess (163 μL of 0.1 M=16.3 μmol) of phosphoramidite and a 24-fold excess of S-ethyl tetrazole (238 μL of 0.25 M=59.5 μmol) relative to polymer-bound 5'-hydroxyl was used in each coupling cycle. Average coupling yields on the 394 Applied Biosystems, Inc. synthesizer, determined by colorimetric quantitation of the trityl fractions, were 97.5–99%. Other oligonucleotide synthesis reagents for the 394 Applied Biosystems, Inc. synthesizer: detritylation solution was 2% TCA in methylene chloride (ABI); capping was performed with 16% N-methyl imidazole in THF (ABI) and 10% acetic anhydride/10% 2,6-lutidine in THF (ABI); oxidation solution was 16.9 mM $I_2$, 49 mM pyridine, 9% water in THF (Millipore). B & J Synthesis Grade acetonitrile was used directly from the reagent bottle. S-Ethyl tetrazole solution (0.25 M in acetonitrile) was made up from the solid obtained from American International Chemical, Inc.

Deprotection of the RNA was performed as follows. The polymer-bound oligoribonucleotide, trityl-off, was transferred from the synthesis column to a 4mL glass screw top vial and suspended in a solution of methylamine (MA) at 65° C. for 10 min. After cooling to −20° C., the supernatant was removed from the polymer support. The support was washed three times with 1.0 mL of $EtOH:MeCN:H_2O/3:1:1$, vortexed and the supernatant was then added to the first supernatant. The combined supernatants, containing the oligoribonucleotide, were dried to a white powder.

The base-deprotected oligoribonucleotide was resuspended in anhydrous TEA.HF/NMP solution (250 μL of a solution of 1.5 mL N-methyl-pyrrolidinone, 750 μL TEA and 1.0 mL TEA.3HF to provide a 1.4M HF concentration) and heated to 65° C. for 1.5 h. The resulting, fully deprotected, oligomer was quenched with 50 mM TEAB (9 mL) prior to anion exchange desalting.

For anion exchange desalting of the deprotected oligomer, the TEAB solution was loaded onto a Qiagen 500® anion exchange cartridge (Qiagen Inc.) that was prewashed with 50 mM TEAB (10 mL). After washing the loaded cartridge with 50 mM TEAB (10 mL), the RNA was eluted with 2 M TEAB (10 mL) and dried down to a white powder.

Inactive hammerhead ribozymes were synthesized by substituting a U Hertel, K. J., et al., 1992, *Nucleic Acids Res.* 20, 3252).

The average stepwise coupling yields were >98% (Wincott et al., 1995 *Nucleic Acids Res.* 23, 2677–2684).

Hairpin ribozymes are synthesized in two parts and annealed to reconstruct the active ribozyme (Chowrira and Burke, 1992 *Nucleic Acids Res.*, 20, 2835–2840). Ribozymes are also synthesized from DNA templates using bacteriophage T7 RNA polymerase (Milligan and Uhlenbeck, 1989, *Methods Enzymol.* 180, 51).

All ribozymes are modified extensively to enhance stability by modification with nuclease resistant groups, for example, 2'-amino, 2'-C-allyl, 2'-flouro, 2'-O-methyl, 2'-H (for a review see Usman and Cedergren, 1992 *TIBS* 17, 34; Usman et al., 1994 *Nucleic Acids Symp. Ser.* 31, 163). Ribozymes are purified by gel electrophoresis using general methods or are purified by high pressure liquid chromatography (HPLC; See Usman et al., PCT Publication No. WO95/23225, the totality of which is hereby incorporated herein by reference) and are resuspended in water.

The sequences of the ribozymes that are chemically synthesized, useful in this study, are shown in Tables II to IX. Those in the art will recognize that these sequences are representative only of many more such sequences where the enzymatic portion of the ribozyme (all but the binding arms) is altered to affect activity. Stem-loop IV sequence of hairpin ribozymes listed in for example Table III (5'-CACGUUGUG-3') can be altered (substitution, deletion, and/or insertion) to contain any sequence, provided a minimum of two base-paired stem structure can form. The sequences listed in Tables II to IX may be formed of ribonucleotides or other nucleotides or non-nucleotides. Such ribozymes are equivalent to the ribozymes described specifically in the Tables.

Optimizing Ribozyme Activity

Figure 2A:
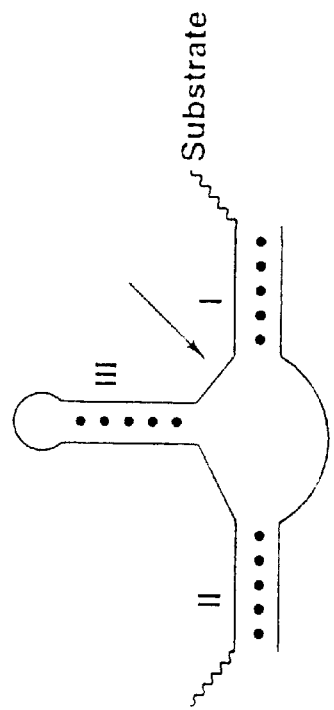
Figure 2B:
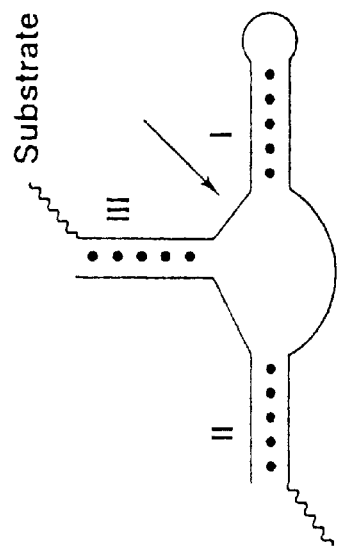
Figure 2C:
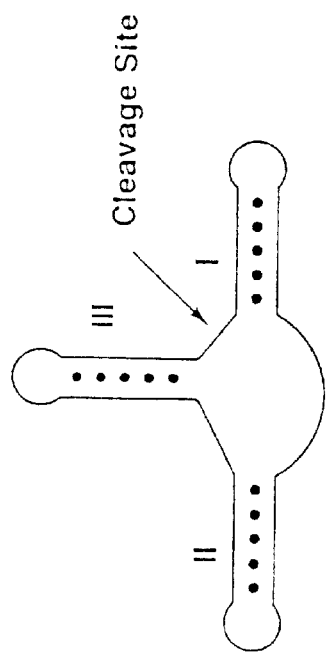
Figure 2D:
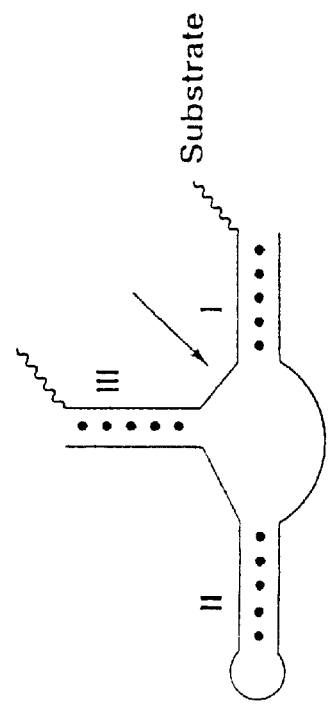

Ribozyme activity can be optimized as described by Stinchcomb et al., supra. The details will not be repeated here, but include altering the length of the ribozyme binding arms (stems I and II, see FIG. 2c), or chemically synthesizing ribozymes with modifications that prevent their degradation by serum ribonucleases (see e.g., Eckstein et al., International Publication No. WO 92/07065; Perrault et al., 1990 *Nature* 344, 565; Pieken et al., 1991 *Science* 253, 314; Usman and Cedergren, 1992 *Trends in Biochem. Sci.* 17, 334; Usman et al., International Publication No. WO 93/15187; Rossi et al., International Publication No. WO 91/03162; Beigelman et al., 1995 *J Biol Chem.* in press; as well as Sproat, U.S. Pat. No. 5,334,711 which describe various chemical modifications that can be made to the sugar moieties of enzymatic RNA molecules). Modifications which enhance their efficacy in cells, and removal of stem II bases to shorten RNA synthesis times and reduce chemical requirements are desired. (All these publications are hereby incorporated by reference herein).

Sullivan, et al., supra, describes the general methods for delivery of enzymatic RNA molecules. Ribozymes may be administered to cells by a variety of methods known to those familiar to the art, including, but not restricted to, encapsulation in liposomes, by iontophoresis, or by incorporation into other vehicles, such as hydrogels, cyclodextrins, biodegradable nanocapsules, and bioadhesive microspheres. For some indications, ribozymes may be directly delivered ex vivo to cells or tissues with or without the aforementioned vehicles. Alternatively, the RNA/vehicle combination is locally delivered by direct injection or by use of a catheter, infusion pump or stent. Other routes of delivery include, but are not limited to, intravascular, intramuscular, subcutaneous or joint injection, aerosol inhalation, oral (tablet or pill form), topical, systemic, ocular, intraperitoneal and/or intrathecal delivery. More detailed descriptions of ribozyme delivery and administration are provided in Sullivan et al., supra and Draper et al., supra which have been incorporated by reference herein.

Another means of accumulating high concentrations of a ribozyme(s) within cells is to incorporate the ribozyme-encoding sequences into a DNA or RNA expression vector. Transcription of the ribozyme sequences are driven from a promoter for eukaryotic RNA polymerase I (pol I), RNA polymerase II (pol II), or RNA polymerase III (pol III). Transcripts from pol II or pol III promoters will be expressed at high levels in all cells; the levels of a given pol II promoter in a given cell type will depend on the nature of the gene regulatory sequences (enhancers, silencers, etc.) present nearby. Prokaryotic RNA polymerase promoters are also used, providing that the prokaryotic RNA polymerase enzyme is expressed in the appropriate cells (Elroy-Stein and Moss, 1990 *Proc. Natl. Acad. Sci. U.S.A.,* 87, 6743–7; Gao and Huang 1993 *Nucleic Acids Res.,* 21, 2867–72; Lieber et al., 1993 *Methods Enzymol.,* 217, 47–66; Zhou et al., 1990 *Mol. Cell. Biol.,* 10, 4529≧37; Thompson et al., 1995 supra). Several investigators have demonstrated that ribozymes expressed from such promoters can function in mammalian cells (e.g. Kashani-Sabet et al., 1992 *Antisense Res. Dev.,* 2, 3–15; Ojwang et al., 1992 *Proc. Natl. Acad. Sci. U.S.A.,* 89,10802–6; Chen et al., 1992 *Nucleic Acids Res.,* 20, 4581–9; Yu et al., 1993 *Proc. Natl. Acad. Sci. U.S.A,* 90, 6340–4; L'Huillier et al., 1992 *EMBO J.* 11, 4411–8; Lisziewicz et al., 1993 *Proc. Natl. Acad. Sci. U.S.A.,* 90, 8000–4; Thompson et al., 1995 *Nucleic Acids Res.* 23, 2259). The above ribozyme transcription units can be incorporated into a variety of vectors for introduction into mammalian cells, including but not restricted to, plasmid DNA vectors, viral DNA vectors (such as adenovirus or adeno-associated virus vectors), or viral RNA vectors (such as retroviral or alphavirus vectors).

In a preferred embodiment of the invention, a transcription unit expressing a ribozyme that cleaves RNAs that encode flt-1, KDR and/or flk-1 are inserted into a plasmid DNA vector or an adenovirus or adeno-associated virus DNA viral vector or a retroviral RNA vector. Viral vectors have been used to transfer genes and lead to either transient or long term gene expression (Zabner et al., 1993 Cell 75, 207; Carter, 1992 *Curr. Opi. Biotech.* 3, 533). The adenovirus, AAV or retroviral vector is delivered as recombinant viral particles. The DNA may be delivered alone or complexed with vehicles (as described for RNA above). The recombinant adenovirus or AAV or retroviral particles are locally administered to the site of treatment, e.g., through incubation or inhalation in vivo or by direct application to cells or tissues ex vivo. Retroviral vectors have also been used to express ribozymes in mammalian cells (Ojwang et al., 1992 supra; Thompson et al., 1995 supra).

flt-1, KDR and/or flk-1 are attractive nucleic acid-based therapeutic targets by several criteria. The interaction between VEGF and VEGF-R is well-established. Efficacy can be tested in well-defined and predictive animal models. Finally, the disease conditions are serious and current therapies are inadequate. Whereas protein-based therapies would inhibit VEGF activity nucleic acid-based therapy provides a direct and elegant approach to directly modulate flt-1, KDR and/or flk-1 expression.

Because flt-1 and KDR mRNAs are highly homologous in certain regions, some ribozyme target sites are also homologous (see Table X). In this case, a single ribozyme will target both flt-1 and KDR mRNAs. At partially homologous sites, a single ribozyme can sometimes be designed to accomodate a site on both mRNAs by including G/U basepairing. For example, if there is a G present in a ribozyme target site in KDR mRNA at the same position there is an A in the flt-1 ribozyme target site, the ribozyme can be synthesized with a U at the complementary position and it will bind both to sites. The advantage of one ribozyme that targets both VEGF-R mRNAs is clear, especially in cases where both VEGF receptors may contribute to the progression of angiogenesis in the disease state.

"Angiogenesis" refers to formation of new blood vessels which is an essential process in reproduction, development and wound repair. "Tumor ngiogenesis" refers to the induction of the growth of blood vessels from surrounding tissue into a solid tumor. Tumor growth and tumor metastasis are dependent on angiogenesis (for a review see Folkman, 1985 supra; Folkman 1990 *J. Natl. Cancer Inst.,* 82, 4; Folkman and Shing, 1992 *J Biol. Chem.* 267, 10931).

Angiogenesis plays an important role in other diseases such as arthritis wherein new blood vessels have been shown to invade the joints and degrade cartilage (Folkman and Shing, supra).

"Retinopathy" refers to inflammation of the retina and/or degenerative condition of the retina which may lead to occlusion of the retina and eventual blindness. In "diabetic retinopathy" angiogenesis causes the capillaries in the retina to invade the vitreous resulting in bleeding and blindness which is also seen in neonatal retinopathy (for a review see Folkman, 1985 supra; Folkman 1990 supra; Folkman and Shing, 1992 supra).

EXAMPLE 1 flt-1. KDR and/or flk-1 Ribozymes

By engineering ribozyme motifs applicant has designed several ribozymes directed against flt-1, KDR and/or flk-1 encoded mRNA sequences. These ribozymes were synthesized with modifications that improve their nuclease resistance (Beigelman et al., 1995 *J Biol. Chem.* 270, 25702) and enhance their activity in cells. The ability of ribozymes to cleave target sequences in vitro was evaluated essentially as described in Thompson et al., PCT Publication No. WO 93/23057; Draper et al., PCT Publication No. WO 95/04818.

EXAMPLE 2
Effect of Ribozymes on the Binding of VEGF to flt-1. KDR and/or flk-1 Receptors Several common human cell lines are available that express endogenous flt-1, KDR and/or flk-1. flt-1, KDR and/or flk-1 can be detected easily with monoclonal antibodies. Use of appropriate fluorescent reagents and fluorescence-activated cell-sorting (FACS) will permit direct quantitation of surface flt-1, KDR and/or flk-1 on a cell-by-cell basis. Active ribozymes are expected to directly reduce flt-1, KDR and/or flk-1 expression and thereby reduce VEGF binding to the cells. In this example, human umbelical cord microvascular endothelial cells were used.

Cell Preparation

Plates are coated with 1.5% gelatin and allowed to stand for one hour. Cells (e.g., microvascular endothelial cells derived from human umbilical cord vein) are plated at 20,000 cells/well (24 well plate) in 200 µl growth media and incubated overnight (~1 doubling) to yield ~40,000 cells (75–80% confluent).

Ribozyme Treatment

Media is removed from cells and the cells are washed two times with 300 µl 1× PBS: $Ca^{2+}$: $Mg^{2+}$ mixture. A complex of 200–500 nM ribozyme and LipofectAMINE® (3:1 lipid:phosphate ratio) in 200 µl OptiMEM® (5% FBS) was added to the cells. The cells are incubated for 6 hr (equivalent to 2–3 VEGF-R turnovers).

$^{125}$I VEGF Binding Assay

The assay is carried out on ice to inhibit internalization of VEGF during the experiment. The media containing the ribozyme is removed from the cells and the cells are washed twice with with 300 µl 1× PBS: $Ca^{2+}$: $Mg^{2+}$ mixture containing 1% BSA. Appropriate $^{125}$I VEGF solution (100,000 cpm/well, +/−10× cold 1× PBS, 1% BSA) was applied to the cells. The cells are incubated on ice for 1 h. $^{125}$I VEGF-containing solution is removed and the cells are washed three times with with 300 µl 1× PBS: $Ca^{2+}$: $Mg^{2+}$ mixture containing 1% BSA. To each well 300 µl of 100 mM Tris-HCl, pH 8.0, 0.5% Triton X-100 was added and the the mixture was incubated for 2 min. The $^{125}$I VEGF-binding was quantitated using standard scintillation counting techniques.

$$\text{Percent Inhibition} = \frac{\text{cpm}^{125} \mid VEGF \text{ bound by the ribozyme-treated samples}}{\text{cpm}^{125} \mid VEGF \text{ bound by the Control sample}} \times 100$$

EXAMPLE 3
Effect of Hammerhead Ribozymes Targeted Against flt-1 Receptor on the Binding of VEGF Hammerhead ribozymes targeted to twenty sites within flt-1 RNA were synthesized as described above. Sequence of the ribozymes used are shown in Table II; the length of stem II region is 3 bp. The hammerhead ribozymes were chemically modified such that the ribozyme consists of ribose residues at five positions; U4 and U7 positions contain 2'-$NH_2$ modifications, the remaining nucleotide positions contain 2'-O-methyl substitutions; four nucleotides at the 5' terminus contains phosphorothioate substitutions. Additionally, 3' end of the ribozyme contains a 3'-3' linked inverted abasic ribose.

Referring to FIG. 7, the effect of hammerhead ribozymes targeted against flt-1 receptor on the binding of VEGF to flt-1 on the surface of human microvascular endothelial cells is shown. The majority of the ribozymes tested were able to inhibit the expression of flt-1 and thereby were able to inhibit the binding of VEGF.

In order to determine the specificity of ribozymes targeted against flt-1 RNA, the effect of five anti-flt-1 ribozymes on the binding of VEGF, UPA (urokinase plasminogen activator) and FGF (fibroblast growth factor) to their corresponding receptors were assayed. As shown in FIG. 9, there was significant inhibition of VEGF binding to its receptors on cells treated with anti-flt-1 ribozymes. There was no specific inhibition of the binding of UPA and FGF to their corresponding receptors. These data strongly suggest that anti-flt-1 ribozymes specifically cleave flt-1 RNA and not RNAs encoding the receptors for UPA and FGF, resulting in the inhibition of flt-1 receptor expression on the surface of the cells. Thus the ribozymes are responsible for the inhibition of VEGF binding but not the binding of UPA and FGF.

EXAMPLE 4
Effect of Hammerhead Ribozymes Targeted Against KDR Receptor on the Binding of VEGF Hammerhead ribozymes targeted to twenty one sites within KDR RNA were synthesized as described above. Sequence of the ribozymes used are shown in Table IV; the length of stem II region is 3 bp. The hammerhead ribozymes were chemically modified such that the ribozyme consists of ribose residues at five positions; U4 and U7 positions contain 2'-$NH_2$ modifications, the remaining nucleotide positions contain 2'-O-methyl substitutions; four nucleotides at the 5' terminus contains phosphorothioate substitutions. Additionally, the 3' end of the ribozyme contains a 3'-3' linked inverted abasic deoxyribose.

Referring to FIG. 8, the effect of hammerhead ribozymes targeted against KDR receptor on the binding of VEGF to KDR on the surface of human microvascular endothelial cells is shown. A majority of the ribozymes tested were able to inhibit the expression of KDR and thereby were able to inhibit the binding of VEGF. As a control, the cells were treated with a ribozyme that is not targeted towards KDR RNA (irrel. RZ); there was no specific inhibition of VEGF binding. The results from this control experiment strongly suggest that the inhibition of VEGF binding observed with anti-KDR ribozymes is a ribozyme-mediated inhibition.

EXAMPLE 5
Effect of Ribozymes Targeted Against VEGF Receptors on Cell Proliferation Cell Preparation 24-well plates are coated with 1.5% gelatin (porcine skin 300 bloom). After 1 hr, excess gelatin is washed off of the plate. Microvascular endothelial cells are plated at 5,000 cells/well (24 well plate) in 200 µl growth media. The cells are allowed to grow for ~18 hr (~1 doubling) to yield ~10,000 cells (25–30% confluent).

Ribozyme Treatment

Media is removed from the cells, and the cells are washed two times with 300 µl 1× PBS: $Ca^{2+}$: $Mg^{2+}$ mixture.

For anti-flt-1 HH ribozyme experiment (FIG. 12) a complex of 500 nM ribozyme; 15 µM LFA (3:1 lipid:phosphate ratio) in 200 µl OptiMEM (5% FCS) media was added to the cells. Incubation of cells is carried out for 6 hr (equivalent to 2–3 VEGF receptor turnovers).

For anti-KDR HH ribozyme experiment (FIG. 13) a complex of 200 nM ribozyme; 5.25 µM LFA (3:1 lipid:phosphate ratio) in 200 µl OptiMEM (5% FCS) media was added to the cells. Incubation of cells is carried out for 3 hr.

Proliferation

After three or six hours, the media is removed from the cells and the cells are washed with 300 μl 1× PBS: $Ca^{2+}$: $Mg^{2+}$mixture. Maintenance media (contains dialyzed 10% FBS) +/−VEGF or basic FGF at 10 ng/ml is added to the cells. The cells are incubated for 48 or 72 h. The cells are trypsinized and counted (Coulter counter). Trypan blue is added on one well of each treatment as control.

Figure 12B:
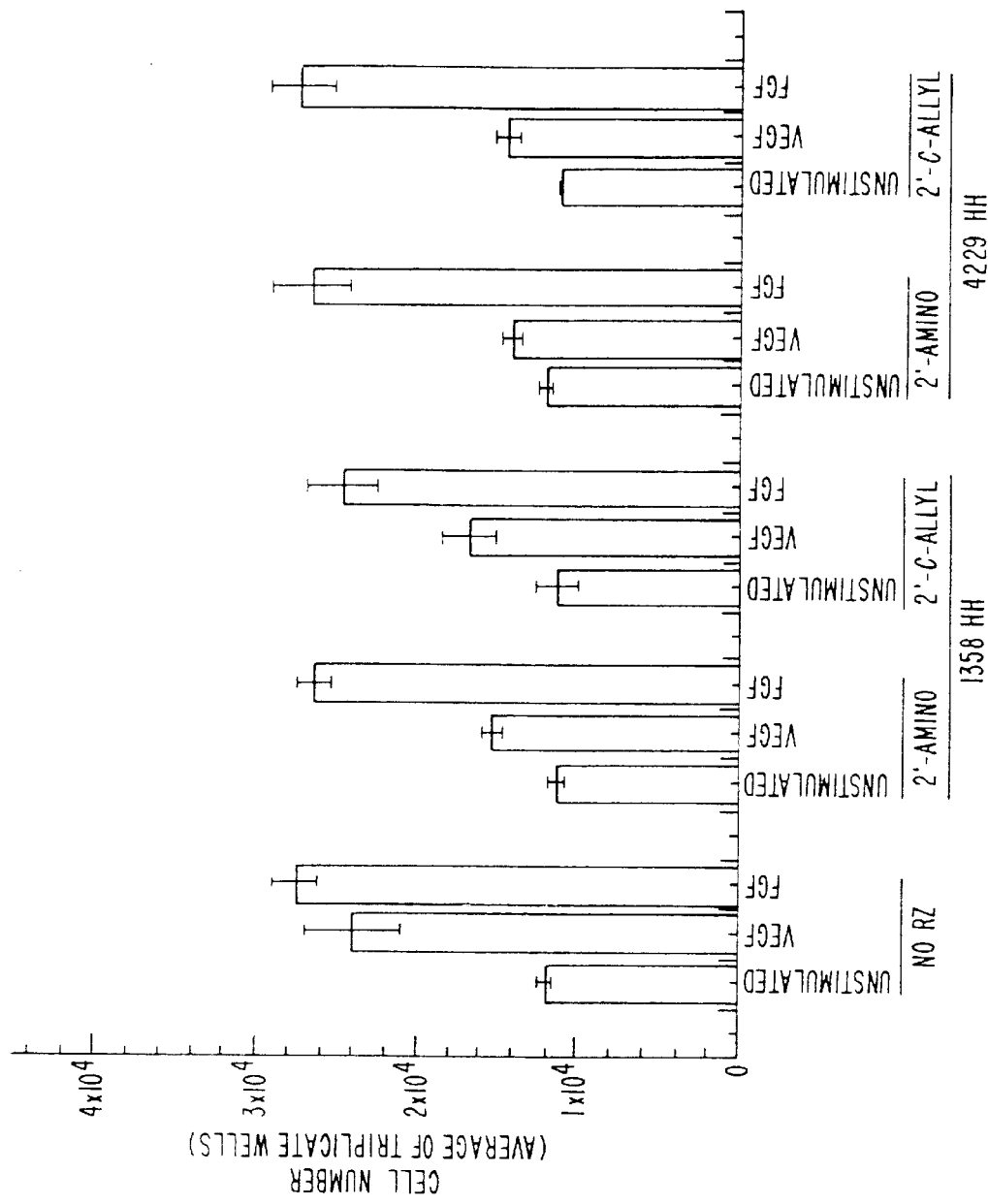

As shown in FIG. 12B, VEGF and basic FGF can stimulate human microvascular endothelial cell proliferation. However, treatment of cells with 1358 HH or 4229 HH ribozymes, targeted against flt-1 mRNA, results in a significant decrease in the ability of VEGF to stimulate endothelial cell proliferation. These ribozymes do not inhibit the FGF-mediated stimulation of endothelial cell proliferation.

Human microvascular endothalial cells were also treated with hammerhead ribozymes targeted against sites 527, 730, 3702 or 3950 within the KDR mRNA. As shown in FIG. 13, all four ribozymes caused significant inhibition of VEGF-mediated induction of cell proliferation. No significant inhibition of cell proliferation was observed when the cells were treated with a hammerhead ribozyme targeted to an irrelevant RNA. Additionally, none of the ribozymes inhibited FGF-mediated stimulation of cell proliferation.

These results strongly suggest that hammerhead ribozymes targeted against either flt-1 or KDR mRNA can specifically inhibit VEGF-mediated induction of endothelial cell proliferation.

EXAMPLE 6

Effect of Antisense Oligonucleotides Targeted Against VEGF Receptors on Cell Proliferation (Colorimetric Assay)

Following are some of the reagents used in the proliferation assay:

Cells: Human aortic endothelial cells (HAEC) from Clonetics®. Cells at early passage are preferably used.

Uptake Medium: EBM (from Clonetics®);1% L-Glutamine;20 mM Hepes;No serum;No antibiotics.

Growth Medium: EGM (from Clonetics®);FBS to 20%;1% L-Glutamine; 20 mM Hepes.

Cell Plating: 96-well tissue culture plates are coated with 0.2% gelatin (50 μl/well). The gelatin is incubated in the wells at room temperature for 15–30 minutes. The gelatin is removed by aspiration and the wells are washed with PBS:$Ca^{2+}$: $Mg^{2+}$mixture. PBS mixture is left in the wells until cells are ready to be added. HAEC cells were detached by trypsin treatment and resuspended at $1.25 \times 10^4$/ml in growth medium. PBS is removed from plates and 200 μl of cells (i.e. $2.5 \times 10^3$ cells/well) are added to each well. The cells are allowed to grow for 48 hours before the proliferation assay.

Assay: Growth medium is removed from the wells. The cells are washed twice with PBS:$Ca^{2+}$: $Mg^{2+}$mixture without antibiotics. A formulation of lipid/antisense oligonucleotide (antisense oligonucleotide is used here as a non-limiting example) complex is added to each well (100 μl/well) in uptake medium. The cells are incubated for 2–3 hours at 37° C. in $C_2$ incubator. After uptake, 100 μl/well of growth medium is added (gives final FBS concentration of 10%). After approximately 72 hours, 40 μl MTS® stock solution (made as described by manufacturer) was added to each well and incubated at 37° C. for 1–3 hours, depending on the color development. (For this assay, 2 hours was sufficient). The intensity of color formation was determined on a plate reader at 490 nM.

Phosphorothioate-substituted antisense oligodeoxynucleotides were custom synthesized by The Midland Certified Reagent Company®, Midland, Tex. Following non-limiting antisense oligodeoxynucleotides targeted against KDR RNA were used in the proliferation assay:

KDR 21 AS: 5'-GCA GCA CCT TGC TCT CCA TCC-3'

SCRAMBLED CONTROL: 5'-CTG CCA ACT TCC CAT GCC TGC-3'

As shown in FIG. 10, proliferation of HAEC cells are specifically inhibited by increasing concentrations of the phosphorothioate anti-KDR-antisense oligodeoxynucleotide. The scrambled antisense oligonucleotide is not expected to bind the KDR RNA and therefore is not expected to inhibit KDR expression. As expected, there is no detectable inhibition of proliferation of HAEC cells treated with a phosphorothioate antisense oligonucleotide with scrambled sequence.

EXAMPLE 7

In Vitro Cleavage of flt-1 RNA by Hammerhead Ribozymes

Referring to FIG. 11A, hammerhead ribozymes (HH) targeted against sites 1358 and 4229 within the flt-1 RNA were synthesized as described above.

RNA Cleavage Assay in vitro

Substrate RNA was 5' end-labeled using [$\gamma$-$^{32}$P] ATP and T4 polynucleotide kinase (US Biochemicals). Cleavage reactions were carried out under ribozyme "excess" conditions. Trace amount ($\leq 1$ nM) of 5' end-labeled substrate and 40 nM unlabeled ribozyme were denatured and renatured separately by heating to 90° C. for 2 min and snap-cooling on ice for 10–15 min. The ribozyme and substrate were incubated, separately, at 37° C. for 10 min in a buffer containing 50 mM Tris-HCl and 10 mM $MgCl_2$. The reaction was initiated by mixing the ribozyme and substrate solutions and incubating at 37° C. Aliquots of 5 μl are taken at regular intervals of time and the reaction is quenched by mixing with equal volume of 2× formamide stop mix. The samples are resolved on 20 % denaturing polyacrylamide gels. The results were quantified and percentage of target RNA cleaved is plotted as a function of time.

Figure 11B:
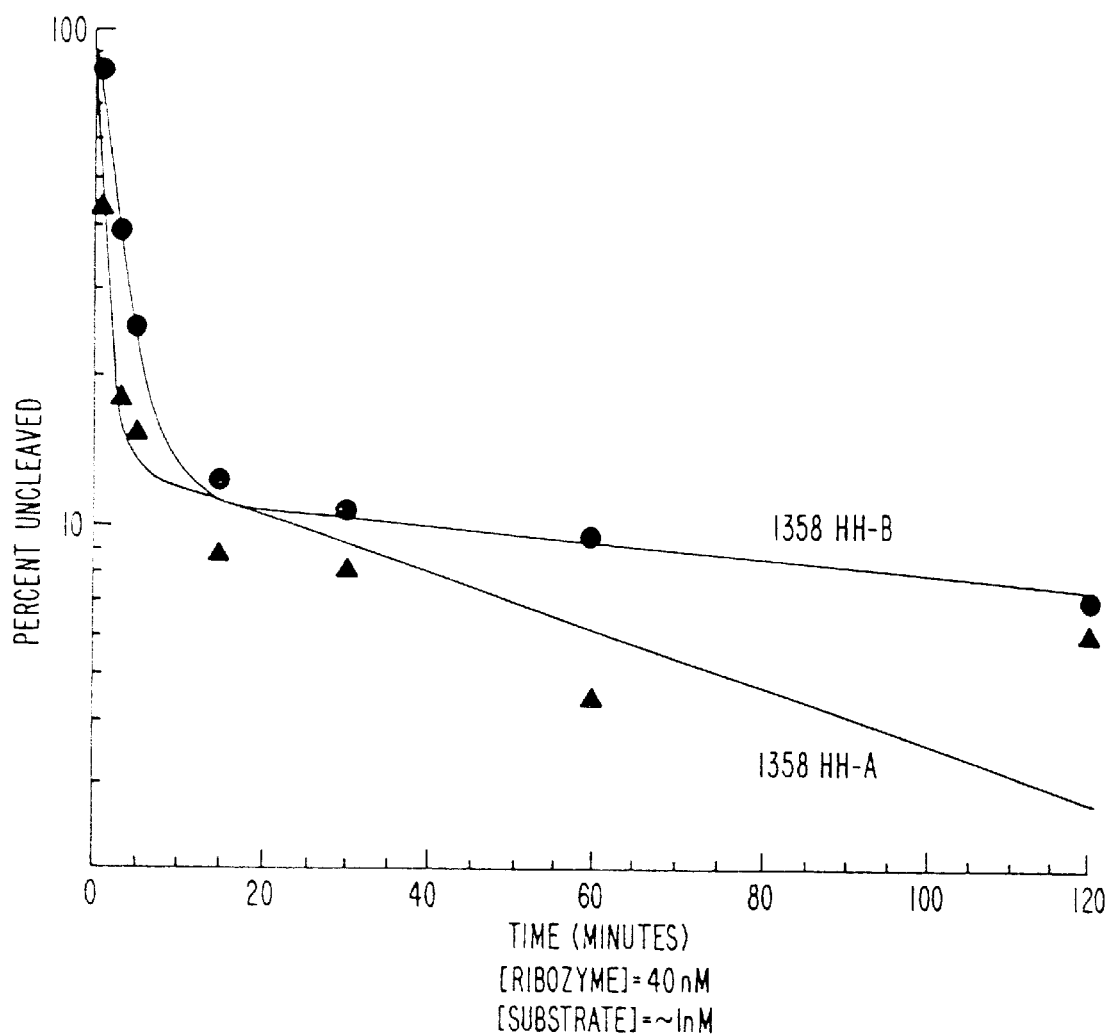

Referring to FIG. 11B and 11C, hammerhead ribozymes targeted against sites 1358 and 4229 within the flt-1 RNA are capable of cleaving target RNA efficiently in vitro.

EXAMPLE 8

In Vitro Cleavage of KDR RNA by Hammerhead Ribozymes

In this non-limiting example, hammerhead ribozymes targeted against sites 726, 527, 3702 and 3950 within KDR RNA were synthesized as described above. RNA cleavage reactions were carried out in vitro essentially as described under Example 7.

Referring to FIGS. 14 and 15, all four ribozymes were able to cleave their cognate target RNA efficiently in a sequence-specific manner.

EXAMPLE 9

In Vitro Cleavage of RNA by Hammerhead Ribozymes Targeted Against Cleavage Sites that are Homologous Between KDR and flt-1 mRNA Because flt-1 and KDR mRNAs are highly homologous in certain regions, some ribozyme target sites are also homologous (see Table X). In this case, a single ribozyme will target both flt-1 and KDR mRNAs. Hammerhead ribozyme (FLT/KDR-I) targeted against one of the homologous sites between flt-1 and KDR (flt-1 site 3388 and KDR site 3151) was synthesized as described above. Ribozymes with either a 3 bp stem II or a 4 bp stem II were synthesized. RNA cleavage reactions were carried out in vitro essentially as described under Example 7.

Referring to FIG. 16, FLT/KDR-I ribozyme with either a 3 or a 4 bp stem II was able to cleave its target RNA efficiently in vitro.

EXAMPLE 10

Effect of Multiple Ribozymes Targeted Against Both flt-1 and KDR RNA on Cell Proliferation Since both flt-1 and KDR receptors of VEGF are involved in angiogenesis, the inhibition of the expression of both of these genes may be an effective approach to inhibit angiogenesis.

Human microvascular endothalial cells were treated with hammerhead ribozymes targeted against sites flt-1 4229 alone, KDR 527 alone, KDR 726 alone, KDR 3950 alone, flt-1 4229+KDR 527, flt-1 4229+KDR 726 or flt-1 4229+ KDR 3950. As shown in FIG. 17, all the combinations of active ribozymes (A) caused significant inhibition of VEGF-mediated induction of cell proliferation. No significant inhibition of cell proliferation was observed when the cells were treated with a catalytically inactive (I) hammerhead ribozymes. Additionally, cells treated with ribozymes targeted against both flt-i and KDR RNAs- flt-1 4229+KDR 527; flt-1 4229+KDR 726; flt-1 4229+KDR 3950, were able to cause a greater inhibition of VEGF-mediated induction of cell proliferation when compared with individual ribozymes targeted against either flt-1 or KDR RNA (see flt-1 4229 alone; KDR 527 alone; KDR 726 alone; KDR 3950 alone). This strongly suggests that treatment of cells with multiple ribozymes may be a more effective means of inhibition of gene expression.

Animal Models

There are several animal models in which the anti-angiogenesis effect of nucleic acids of the present invention, such as ribozymes, directed against VEGF-R mRNAs can be tested. Typically a corneal model has been used to study angiogenesis in rat and rabbit since recruitment of vessels can easily be followed in this normally avascular tissue (Pandey et al., 1995 *Science* 268: 567–569). In these models, a small Teflon or Hydron disk pretreated with an angiogenesis factor (e.g. bFGF or VEGF) is inserted into a pocket surgically created in the cornea. Angiogenesis is monitored 3 to 5 days later. Ribozymes directed against VEGF-R mRNAs would be delivered in the disk as well, or dropwise to the eye over the time course of the experiment. In another eye model, hypoxia has been shown to cause both increased expression of VEGF and neovascularization in the retina (Pierce et al., 1995 *Proc. Natl. Acad. Sci. USA.* 92: 905–909; Shweiki et al., 1992 *J. Clin. Invest,* 91: 2235–2243).

In human glioblastomas, it has been shown that VEGF is at least partially responsible for tumor angiogenesis (Plate et al., 1992 *Nature* 359, 845). Animal models have been developed in which glioblastoma cells are implanted subcutaneously into nude mice and the progress of tumor growth and angiogenesism is studied (Kim et al., 1993 supra; Millauer et al., 1994 supra).

Another animal model that addresses neovascularization involves Matrigel, an extract of basement membrane that becomes a solid gel when injected subcutaneously (Passaniti et al., 1992 *Lab. Invest.* 67: 519–528). When the Matrigel is supplemented with angiogenesis factors such as VEGF, vessels grow into the Matrigel over a period of 3 to 5 days and angiogenesis can be assessed. Again, ribozymes directed against VEGF-R mRNAs would be delivered in the Matrigel.

Several animal models exist for screening of anti-angiogenic agents. These include corneal vessel formation following corneal injury (Burger et al., 1985 Cornea 4: 35–41; Lepri, et al., 1994 *J. Ocular Pharmacol.* 10: 273–280; Ormerod et al., 1990 *Am. J. Pathol.* 137: 1243–1252) or intracorneal growth factor implant (Grant et al., 1993 *Diabetologia* 36: 282–291; Pandey et al. 1995 supra; Zieche et al., 1992 *Lab. Invest* 67: 711–715), vessel growth into Matrigel matrix containing growth factors (Passaniti et al., 1992 supra), female reproductive organ neovascularization following hormonal manipulation (Shweiki et al., 1993 *Clin. Invest.* 91: 2235–2243), several models involving inhibition of tumor growth in highly vascularized solid tumors (O'Reilly et al., 1994 *Cell* 79: 315–328; Senger et al., 1993 *Cancer and Metas. Rev.* 12: 303–324; Takahasi et al., 1994 *Cancer Res.* 54: 4233–4237; Kim et al., 1993 supra), and transient hypoxia-induced neovascularization in the mouse retina (Pierce et al., 1995 *Proc. Natl. Acad. Sci. USA.* 92: 905–909).

The cornea model, described in Pandey et al. supra, is the most common and well characterized anti-angiogenic agent efficacy screening model. This model involves an avascular tissue into which vessels are recruited by a stimulating agent (growth factor, thermal or alkalai burn, endotoxin). The corneal model would utilize the intrastromal corneal implantation of a Teflon pellet soaked in a VEGF-Hydron solution to recruit blood vessels toward the pellet which can be quantitated using standard microscopic and image analysis techniques. To evaluate their anti-angiogenic efficacy, ribozymes are applied topically to the eye or bound within Hydron on the Teflon pellet itself. This avascular cornea as well as the Matrigel (see below) provide for low background assays. While the corneal model has been performed extensively in the rabbit, studies in the rat have also been conducted.

The mouse model (Passaniti et al., supra) is a non-tissue model which utilizes Matrigel, an extract of basement membrane (Kleinman et al., 1986) or Millipore® filter disk, which can be impregnated with growth factors and anti-angiogenic agents in a liquid form prior to injection. Upon subcutaneous administration at body temperature, the Matrigel or Millipore® filter disk forms a solid implant. VEGF embedded in the Matrigel or Millipore® filter disk would be used to recruit vessels within the matrix of the Matrigel or Millipore® filter disk which can be processed histologically for endothelial cell specific vWF (factor VIII antigen) immunohistochemistry, Trichrome-Masson stain, or hemoglobin content. Like the cornea, the Matrigel or Millipore® filter disk are avascular; however, it is not tissue. In the Matrigel or Millipore® filter disk model, ribozymes are administered within the matrix of the Matrigel or Millipore® filter disk to test their anti-angiogenic efficacy. Thus, delivery issues in this model, as with delivery of ribozymes by Hydron- coated Teflon pellets in the rat cornea model, may be less problematic due to the homogeneous presence of the ribozyme within the respective matrix.

These models offer a distinct advantage over several other angiogenic models listed previously. The ability to use VEGF as a pro-angiogenic stimulus in both models is highly desirable since ribozymes will target only VEGFr mRNA. In other words, the involvement of other non-specific types of stimuli in the cornea and Matrigel models is not advantageous from the standpoint of understanding the pharmacologic mechanism by which the anti-VEGFr mRNA ribozymes produce their effects. In addition, the models will allow for testing the specificity of the anti-VEGFr mRNA ribozymes by using either a- or bFGF as a pro-angiogenic factor. Vessel recruitment using FGF should not be affected in either model by anti-VEGFr mRNA ribozymes. Other models of angiogenesis including vessel formation in the female reproductive system using hormonal manipulation (Shweiki et al., 1993 supra); a variety of vascular solid tumor models which involve indirect correltations with angiogenesis (O'Reilly et al., 1994 supra; Senger et al., 1993 supra; Takahasi et al., 1994 supra; Kim et al., 1993 supra); and retinal neovascularization following transient hypoxia (Pierce et al., 1995 supra) were not selected for efficacy screening due to their non-specific nature, although there is a correlation between VEGF and angiogenesis in these models.

Other model systems to study tumor angiogenesis is reviewed by Folkman, 1985 Adv. Cancer. Res. 43,175.

flt-1, KDR and/or flk-1 protein levels can be measured clinically or experimentally by FACS analysis. flt-1, KDR and/or flk-1 encoded mRNA levels will be assessed by Northern analysis, RNase-protection, primer extension analysis and/or quantitative RT-PCR. Ribozymes that block flt-1, KDR and/or flk-1 protein encoding mRNAs and therefore result in decreased levels of flt-1, KDR and/or flk-1 activity by more than 20% in vitro will be identified.

Ribozymes and/or genes encoding them are delivered by either free delivery, liposome delivery, cationic lipid delivery, adeno-associated virus vector delivery, adenovirus vector delivery, retrovirus vector delivery or plasmid vector delivery in these animal model experiments (see above).

Patients can be treated by locally administering nucleic acids targeted against VEGF-R by direct injection. Routes of administration may include, but are not limited to, intravascular, intramuscular, subcutaneous, intraarticular, aerosol inhalation, oral (tablet, capsule or pill form), topical, systemic, ocular, intraperitoneal and/or intrathecal delivery.

EXAMPLE 11

Ribozyme-mediated Inhibition of Angiogenesis in vivo

The purpose ot this study was to assess the anti-angiogenic activity of hammerhead ribozymes targeted against flt-1 4229 site in the rat cornea model of VEGF induced angiogenesis (see above). These ribozymes have either active or inactive catalytic core and either bind and cleave or just bind to VEGF-R mRNA of the flt-1 subtype. The active ribozymes, that are able to bind and cleave the target RNA, have been shown to inhibit ($^{125}$I-labeled) VEGF binding in cultured endothelial cells and produce a dose-dependent decrease in VEGF induced endothelial cell proliferation in these cells (see Examples 3–5 above). The catalytically inactive forms of these ribozymes, wherein the ribozymes can only bind to the RNA but cannot catalyze RNA cleavage, fail to show these characteristics. The ribozymes and VEGF were co-delivered using the filter disk method: Nitrocellulose filter disks (Millipore®) of 0.057 diameter were immersed in appropriate solutions and were surgically implanted in rat cornea as described by Pandey et al., supra. This delivery method has been shown to deliver rhodamine-labeled free ribozyme to scleral cells and, in all likelihood cells of the pericorneal vascular plexus. Since the active ribozymes show cell culture efficacy and can be delivered to the target site using the disk method, it is essential that these ribozymes be assessed for in vivo anti-angiogenic activity.

The stimulus for angiogenesis in this study was the treatment of the filter disk with 30 $\mu$M VEGF which is implanted within the cornea's stroma. This dose yields reproducible neovascularization stemming from the pericorneal vascular plexus growing toward the disk in a dose-response study 5 days following implant. Filter disks treated only with the vehicle for VEGF show no angiogenic response. The ribozymes was co-adminstered with VEGF on a disk in two different ribozyme concentrations. One concern with the simultaneous administration is that the ribozymes will not be able to inhibit angiogenesis since VEGF receptors can be stimulated. However, we have observed that in low VEGF doses, the neovascular response reverts to normal suggesting that the VEGF stimulus is essential for maintaining the angiogenic response. Blocking the production of VEGF receptors using simultaneous administration of anti-VEGF-R mRNA ribozymes could attenuate the normal neovascularization induced by the filter disk treated with VEGF.

Materials and Methods:

Stock hammerhead ribozyme solutions
  a. flt-1 4229 (786 $\mu$M)- Active
  b. flt-1 4229 (736 $\mu$M)- Inactive 2. Experimantal Solutions/groups Group 1 Solution 1 Control VEGF solution: 30 $\mu$M in 82 mM Tris base Group 2 Solution 2 flt-1 4229 (1 $\mu$g/$\mu$L) in 30 $\mu$M VEGF/82 mM Tris base Group 3 Solution 3 flt-1 4229 (10 $\mu$g/$\mu$L) in 30 $\mu$M VEGF/82 mM Tris base Group 4 Solution 4 No VEGF, flt-1 4229 (10 $\mu$g/$\mu$L) in 82 mM Tris base Group 5 Solution 5 No VEGF, No ribozyme in 82 mM Tris base 10 eyes per group, 5 animals (Since they have similar molecular weights, the molar concentrations should be essentially similar).

Each solution (VEGF and RIBOZYMES) were prepared as a 2× solution for 1:1 mixing for final concentrations above, with the exception of solution 1 in which VEGF was 2× and diluted with ribozyme diluent (sterile water).

3. VEGF Solutions

The 2× VEGF solution (60 $\mu$M) was prepared from a stock of 0.82 $\mu$g/$\mu$L in 50 mM Tris base. 200 $\mu$L of VEGF stock was concentrated by speed vac to a final volume of 60.8 $\mu$L, for a final concentration of 2.7 $\mu$g/$\mu$L or 60 $\mu$M. Six 10 $\mu$L aliquots was prepared for daily mixing. 2× solutions for VEGF and Ribozyme was stored at 4° C. until the day of the surgery. Solutions were mixed for each day of surgery. Original 2× solutions was prepared on the day before the first day of the surgery.

4. Surgical Solutions

Anesthesia
  stock ketamine hydrochloride 100 mg/mL
  stock xylazine hydrochloride 20 mg/mL
  stock acepromazine 10 mg/mL
  Final anesthesia solution: 50 mg/mL ketamine, 10 mg/mL xylazine, and 0.5 mg/mL acepromazine
  5% povidone iodine for opthalmic surgical wash 2% lidocaine (sterile) for opthalmic administration (2 drops per eye)
  sterile 0.9% NaCl for opthalmic irrigation 5. Surgical Methods Standard surgical procedure as described in Pandey et al., supra. Filter disks were incubated in 1 $\mu$L of each solution for approximately 30 minutes prior to implantation.

5. Experimental Protocol

The animal cornea were treated with the treatment groups as described above. Animals were allowed to recover for 5 days after treatment with daily observation (scoring 0–3). On the fifth day animals were euthanized and digital images of each eye was obtained for quantitaion using Image Pro Plus. Quantitated neovascular surface area were analyzed by ANOVA followed by two post-hoc tests including Dunnets and Tukey-Kramer tests for significance at the 95% confidence level. Dunnets provide information on the significance between the differences within the means of treatments vs. controls while Tukey-Kramer provide information on the significance of differences within the means of each group.

Results are graphically represented in FIG. 18. As shown in the figure, flt-1 4229 active hammerhead ribozyme at both concentrations was effective at inhibiting angiogenesis while the inactive ribozyme did not show any significant reduction in angiogenesis. A statistically signifiant reduction in neovascular surface area was observed only with active ribozymes. This result clearly shows that the ribozymes are capable of significantly inhibiting angiogenesis in vivo. Specifically, the mechanism of inhibition appears to be by the binding and cleavage of target RNA by ribozymes.

Diagnostic Uses

Ribozymes of this invention may be used as diagnostic tools to examine genetic drift and mutations within diseased cells or to detect the presence of flt-1, KDR and/or flk-1 RNA in a cell. The close relationship between ribozyme activity and the structure of the target RNA allows the detection of mutations in any region of the molecule which alters the base-pairing and three-dimensional structure of the target RNA. By using multiple ribozymes described in this invention, one may map nucleotide changes which are important to RNA structure and function in vitro, as well as in cells and tissues. Cleavage of target RNAs with ribozymes may be used to inhibit gene expression and define the role (essentially) of specified gene products in the progression of disease. In this manner, other genetic targets may be defined as important mediators of the disease. These experiments will lead to better treatment of the disease progression by affording the possibility of combinational therapies (e.g., multiple ribozymes targeted to different genes, ribozymes coupled with known small molecule inhibitors, or intermittent treatment with combinations of ribozymes and/or other chemical or biological molecules). Other in vitro uses of ribozymes of this invention are well known in the art, and include detection of the presence of mRNAs associated with flt-1, KDR and/or flk-1 related condition. Such RNA is detected by determining the presence of a cleavage product after treatment with a ribozyme using standard methodology.

In a specific example, ribozymes which can cleave only wild-type or mutant forms of the target RNA are used for the assay. The first ribozyme is used to identify wild-type RNA present in the sample and the second ribozyme will be used to identify mutant RNA in the sample. As reaction controls, synthetic substrates of both wild-type and mutant RNA will be cleaved by both ribozymes to demonstrate the relative ribozyme efficiencies in the reactions and the absence of cleavage of the "non-targeted" RNA species. The cleavage products from the synthetic substrates will also serve to generate size markers for the analysis of wild-type and mutant RNAs in the sample population. Thus each analysis will require two ribozymes, two substrates and one unknown sample which will be combined into six reactions. The presence of cleavage products will be determined using an RNAse protection assay so that full-length and cleavage fragments of each RNA can be analyzed in one lane of a polyacrylamide gel. It is not absolutely required to quantify the results to gain insight into the expression of mutant RNAs and putative risk of the desired phenotypic changes in target cells. The expression of mRNA whose protein product is implicated in the development of the phenotype (i.e., flt-1, KDR and/or flk-1) is adequate to establish risk. If probes of comparable specific activity are used for both transcripts, then a qualitative comparison of RNA levels will be adequate and will decrease the cost of the initial diagnosis. Higher mutant form to wild-type ratios will be correlated with higher risk whether RNA levels are compared qualitatively or quantitatively.

TABLE I

Characteristics of Ribozymes

Group I Introns

Size: ~200 to >1000 nucleotides.
Requires a U in the target sequence immediately 5' of the cleavage site.
Binds 4–16 nucleotides at 5' side of cleavage site.
Over 75 known members of this class. Found in *Tetrahymena thermophila* rRNA, fungal mitochondria, chloroplasts, phage T4, blue-green algae, and others.

RNAseP RN (M1 RNA)

Size: ~290 to 400 nucleotides.
RNA portion of a ribonucleoprotein enzyme. Cleaves tRNA precursors to form mature tRNA.
Roughly 10 known members of this group all are bacterial in origin.

Hammerhead Ribozyme

Figure 1:
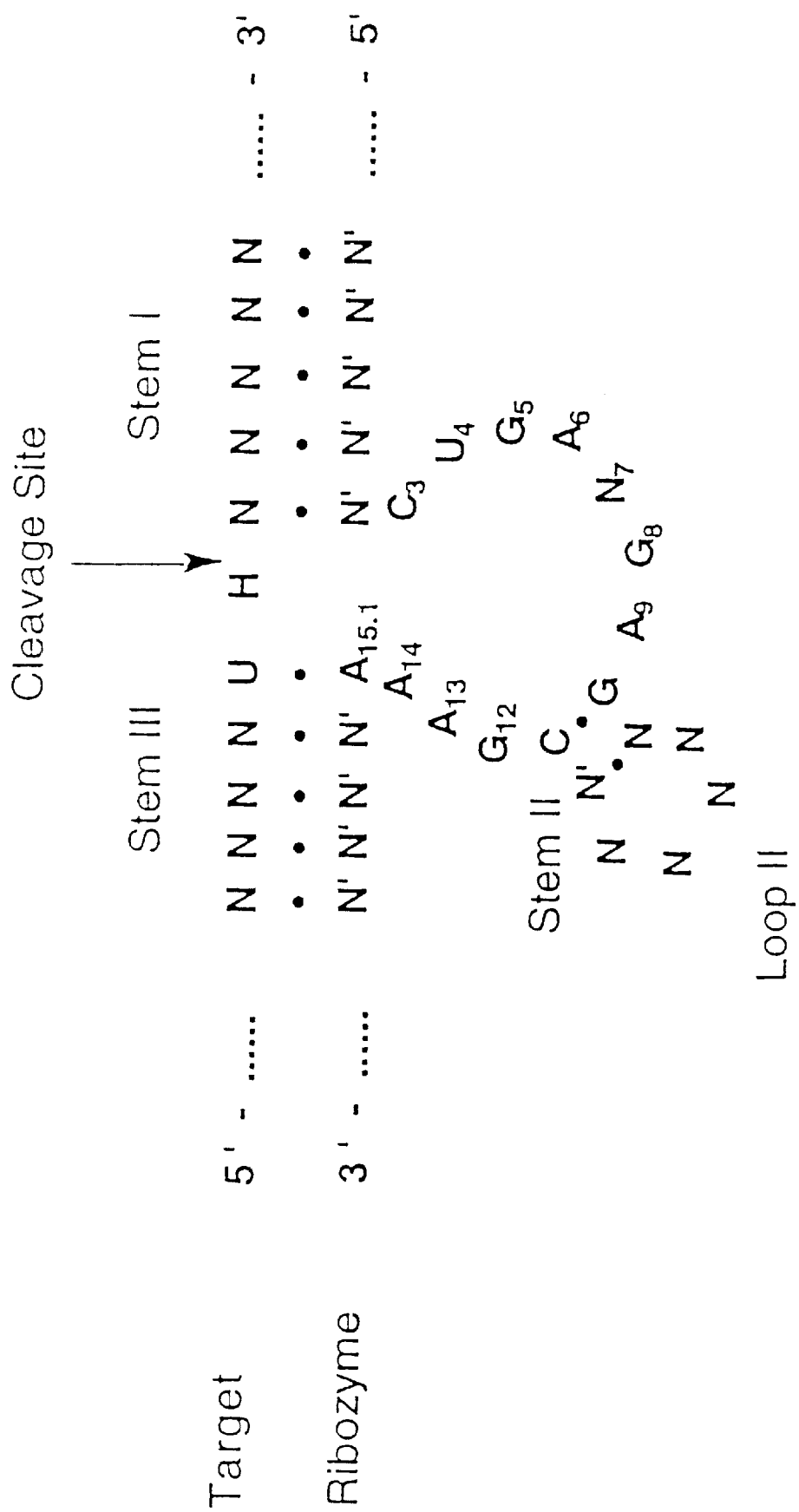

Size: ~13 to 40 nucleotides.
Requires the target sequence UH immediately 5' of the cleavage site.
Binds a variable number of nucleotides on both sides of the cleavage site.
14 known members of this class. Found in a number of plant pathogens (virusoids) that use RNA as the infectious agent (FIG. 1 and 2)

Hairpin Ribozyme

Figure 3:
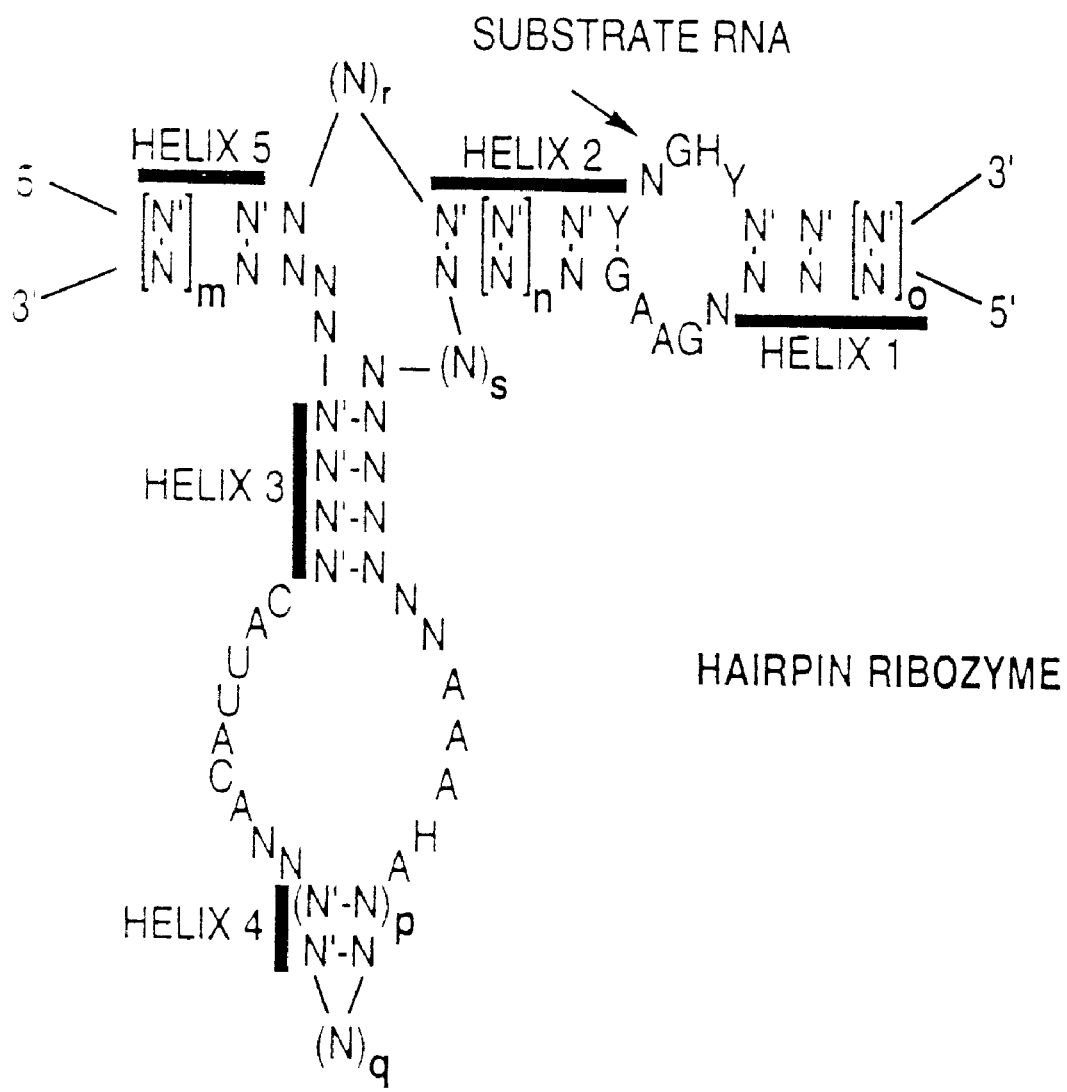

Size: ~50 nucleotides.
Requires the target sequence GUC immediately 3' of the cleavage site.
Binds 4–6 nucleotides at 5' side of the cleavage site and a variable number of the 3' side of the cleavage site.
Only 3 known member of this class. Found in three plant pathogen (satellite RNAs of the tobacco ringspot virus, arabis mosaic virus and chicory yellow mottle virus) which uses RNA as the infectious agent (FIG. 3).

Hepatitis Delta Virus (HDV) Ribozyme

Figure 4:
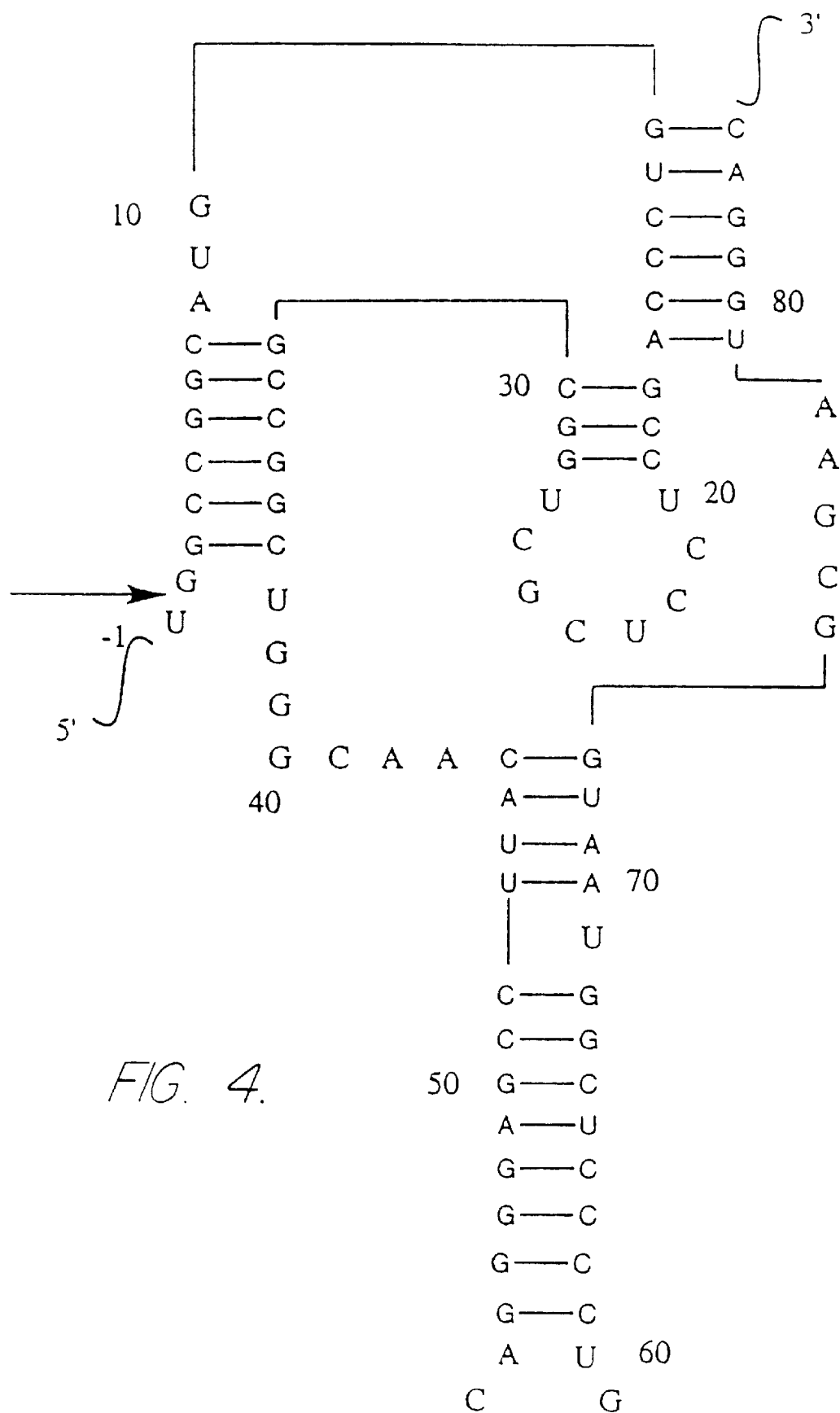
FIG. 4 is a representation of the general structure of the hepatitis delta virus ribozyme domain known in the art.

Size: 50–60 nucleotides (at present).
Sequence requirements not fully determined.
Binding sites and structural requirements not fully determined, although no sequences 5' of cleavage site are required.
Only 1 known member of this class. Found in human HDV (FIG. 4).

Neurospora VS RNA Ribozyme

Figure 5:
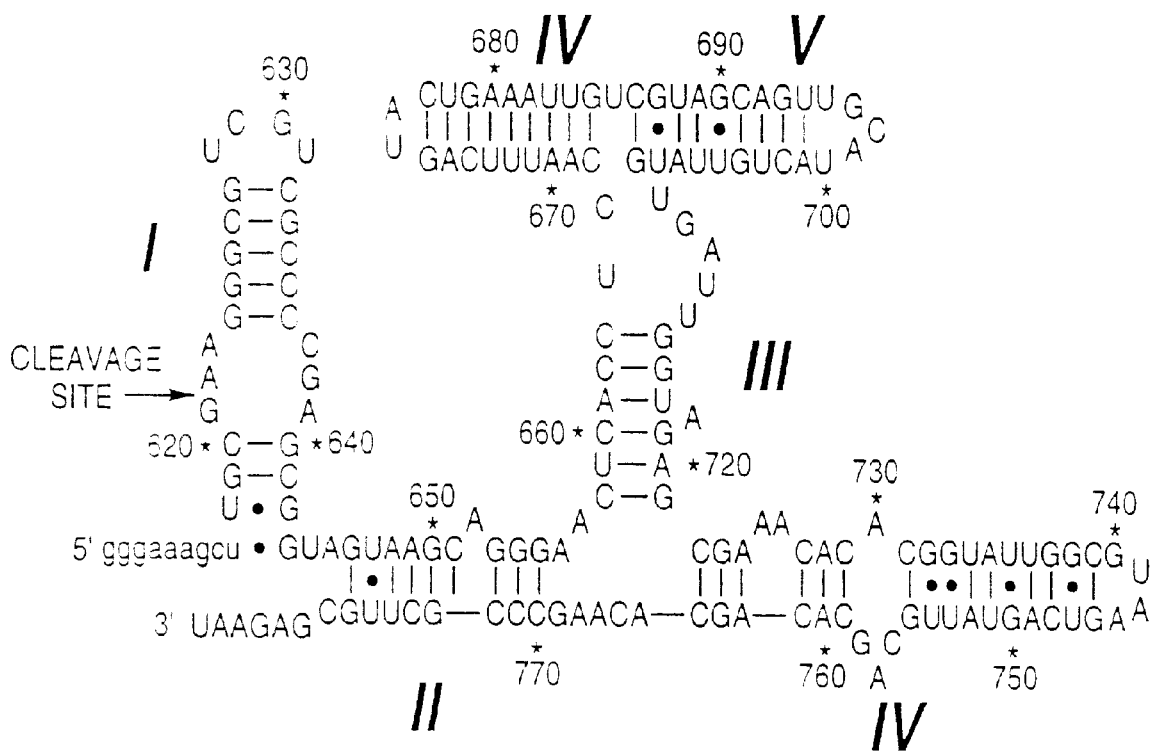
FIG. 5 is a representation of the general structure of the VS RNA ribozyme domain (SEQ ID NO:8).

Size: ~144 nucleotides (at present)
Cleavage of target RNAs recently demonstrated.
Sequence requirements not fully determined.
Binding sites and structural requirements not fully determined. Only 1 known member of this class. Found in Neurospora VS RNA (FIG. 5).

TABLE II

Human flt1 VEGF Receptor-Hammerhead Ribozyme and Substrate Sequence

| nt. Position | HH Ribozyme | Substrate |
|---|---|---|
| 10 | GCCGAGAG CUGAUGA X GAA AGUGUCCG | CGGACACUC CUCUCGGC |
| 13 | GGAGCCGA CUGAUGA X GAA AGGAGUGU | ACACUCCUC UCGGCUCC |
| 15 | GAGGAGCC CUGAUGA X GAA AGAGGAGU | ACUCCUCUC GGCUCCUC |
| 20 | CCGGGGAG CUGAUGA X GAA AGCCGAGA | UCUCGGCUC CUCCCCGG |
| 23 | CUGCCGGG CUGAUGA X GAA AGGAGCCG | CGCCUCCUC CCCGGCAG |
| 43 | CCCGCCCC CUGAUGA X GAA AGCCGCCG | CGGCGGCUC GGAGCGGG |
| 54 | GAGCCCCG CUGAUGA X GAA AGCCCGCU | AGCGGGCUC CGGGGCUC |
| 62 | CUGCACCC CUGAUGA X GAA AGCCCCGG | CCGGGGCUC GGGUGCGG |
| 97 | CCCCGGGU CUGAUGA X GAA AUCCUCGC | GCGAGGAUU ACCCGGGG |
| 98 | UCCCCGGG CUGAUGA X GAA AAUCCUGG | CGAGGAUUA CCCGGGGA |
| 113 | CAGGAGAC CUGAUGA X GAA ACCACUUC | GAAGUGGUU GUCUCCUG |
| 116 | AGCCAGGA CUGAUGA X GAA ACAACCAC | GUGGUUGUC UCCUGGCU |
| 118 | CCAGCCAG CUGAUGA X GAA AGACAACC | GGUUGUCUC CUGGCUGG |
| 145 | CGCGCCCU CUGAUGA X GAA AGCGCCCG | CGGGCGCUC AGGGCGCG |
| 185 | GGCCGCCA CUGAUGA X GAA AGUCCGUC | GACGGACUC UGGCGGCC |
| 198 | CGGCCAAC CUGAUGA X GAA ACCCGGCC | GGCCGGGUC GUUGGCCG |
| 201 | CCCCGGCC CUGAUGA X GAA ACGACCCG | CGGGUCGUU GGCCGGGG |
| 240 | GUGAGCGC CUGAUGA X GAA ACGCGGCC | GGCCGCGUC GCGCUCAC |
| 246 | ACCAUGGU CUGAUGA X GAA AGCGCGAC | GUCGCGCUC ACCAUGGU |
| 255 | CAGUAGCU CUGAUGA X GAA ACCAUGGU | ACCAUGGUC AGCUACUG |
| 260 | UGUCCCAG CUGAUGA X GAA AGCUCACC | GGUCAGCUA CUGGGACA |
| 276 | CACAGCAG CUGAUGA X GAA ACCCCGGU | ACCGGGGUC CUGCUGUG |
| 294 | ACACAGCU CUGAUGA X GAA AGCAGCGC | GCGCUGCUC AGCUGUCU |
| 301 | GAGAAGCA CUGAUGA X GAA ACAGCUGA | UCAGCUGUC UGCUUCUC |
| 306 | CCUGUGAG CUGAUGA X GAA AGCAGACA | UGUCUGCUU CUCACAGG |
| 307 | UCCUGUGA CUGAUGA X GAA AAGCAGAC | GUCUGCUUC UCACAGGA |
| 309 | GAUCCUGU CUGAUGA X GAA AGAAGCAG | CUGCUUCUC ACAGGAUC |
| 317 | CUGAACUA CUGAUGA X GAA AUCCUGUG | CACAGGAUC UUGUUCAG |
| 319 | ACCUGAAC CUGAUGA X GAA AGAUCCUG | CAGGAUCUA GUUCAGGU |
| 322 | UGAACCUG CUGAUGA X GAA ACUAGAUC | GAUCUAGUU CAGGUUCA |
| 323 | UUGAACCU CUGAUGA X GAA AACUAGAU | AUCUAGUUC AGGUUCAA |
| 328 | UAAUUUUG CUGAUGA X GAA ACCUGAAC | GUUCAGGUU CAAAAUUA |
| 329 | UUAAUUUU CUGAUGA X GAA AACCUGAA | UUCAGGUUC AAAAUUAA |
| 335 | GAUCUUUU CUGAUGA X GAA AUUUUGAA | UUCAAAAUU AAAAGAUC |
| 336 | GGAUCUUU CUGAUGA X GAA AAUUUUGA | UCAAAAUUA AAAGACCC |
| 343 | CAGUUCAG CUGAUGA X GAA AUCUUUUA | UAAAAGAUC CUGAACUG |
| 355 | GCCUUUUA CUGAUGA X GAA ACUCAGUU | AACUGAGUU UAAAAGGC |

TABLE II-continued

Human flt1 VEGF Receptor-Hammerhead Ribozyme and Substrate Sequence

| nt. Position | HH Ribozyme | Substrate |
|---|---|---|
| 356 | UGCCUUUU CUGAUGA X GAA AACAGAGU | ACUGAGUUU AAAAGGCA |
| 357 | GGCCCUUU CUGAUGA X GAA AAACUCAG | CUGAGUUUA AAAGGCAC |
| 375 | GCUUGCAU CUGAUGA X GAA AUGUGCUG | CAGCACAUC AUGCAACC |
| 400 | GCAUUGGA CUGAUGA X GAA AUGCAGUG | CACUCCAUC UCCAAUGC |
| 402 | CUGCAUUG CUGAUGA X GAA AGAUGCAG | CUGCAUCUC CAAUGCAG |
| 427 | AGACCAUU CUGAUGA X GAA AUGGGCUG | CAGCCCAUA AAUGGUCU |
| 434 | CAGGCAAA CUGAUGA X GAA ACCAUUUA | UAAAUGGUC UUUGCCUG |
| 436 | UUCAGGCA CUGAUGA X GAA ACACCAUU | AAUGGUCUU UGCCUGAA |
| 437 | UUUCAGGC CUGAUGA X GAA AAGAUCAU | AUGGUCUUU GCCUGAAA |
| 454 | GCUUUCCU CUGAUGA X GAA ACUCACCA | UGGUGAGUA AGGAAAGC |
| 477 | GAUUUAGU CUGAUGA X GAA AUGCUCAG | CUGAGCAUA ACUAAAUC |
| 481 | GGCAGAUU CUGAUGA X GAA AGUUAUGC | GCAUAACUA AAUCUGCC |
| 485 | CACAGGCA CUGAUGA X GAA AUUUAGUU | AACUAAAUC UGCCUGUG |
| 512 | UACUGCAG CUGAUGA X GAA AUUGUUUG | CAAACAAUU CUGCAGUA |
| 513 | GUACUGCA CUGAUGA X GAA AAUUGUUU | AAACAAUUC UGCAGGAC |
| 520 | GGUUAAAG CUGAUGA X GAA ACUGCAGA | UCUGCAGUA CUUUAACC |
| 523 | CAAGGUUA CUGAUGA X GAA AGUACUGC | GCAGUACUU UAACCUUG |
| 524 | UCAAGGUU CUGAUGA X GAA AAGUACUG | CAGUACUUU AACCUUGA |
| 525 | UUCAAGGU CUGAUGA X GAA AAAGUACU | AGUACUUUA ACCUUGAA |
| 530 | CUGUGUUC CUGAUGA X GAA AGGUUAAA | UUUAACCUU GAACACCG |
| 541 | GUUUGCUU CUGAUGA X GAA AGCUCUGU | ACACAGCUC AAGCAAAC |
| 560 | AGCUGUAG CUGAUGA X GAA AGCCAGUG | CACUGGCUU CUACAGCU |
| 561 | CAGCUGUA CUGAUGA X GAA AAGCCAGU | ACUGGCUUC UACAGCUG |
| 563 | UGCAGCUG CUGAUGA X GAA AGAAGCCA | UGGCUUCUA CAGCUGCA |
| 575 | CAGCUAGA CUGAUGA X GAA AUUUGCAG | CUUCAAAUA UCCAGCUG |
| 577 | UACAGCUA CUGAUGA X GAA AUAUUUGC | GCAAAUAUC UAGCUGUA |
| 579 | GGUACAGC CUGAUGA X GAA AGAUAUUU | AAAUAUCUA GCUGUACC |
| 585 | GAAGUGGG CUGAUGA X GAA ACAGCCAG | CUAGCUGUA CCUACUUC |
| 589 | CUUUGAAG CUGAUGA X GAA AGGUACAG | CUGUACCUA CUUCAAAG |
| 592 | CUUCUUUG CUGAUGA X GAA AGUAGGUA | UACCACUU CAAAGAAG |
| 593 | UCUUCUUU CUGAUGA X GAA AAGGAGGU | ACCACUUC AAAGAAGA |
| 614 | AGAUUGCA CUGAUGA X GAA AUUCUGUU | AACAGAAUC UGCAAUCU |
| 621 | AAUAUAUA CUGAUGA X GAA AUUGCAGA | UCUGCAAUC UAUAUAUU |
| 623 | UAAUAUA CUGAUGA X GAA AGAUUGCA | UGCAAUCUA UUUAUUUA |
| 625 | AAUAAAUA CUGAUGA X GAA AUAGAUUG | CAAUCUAUA UAUUUAUU |
| 627 | CUAAUAAA CUGAUGA X GAA AUAUAGAU | AUCUAUAUA UUUAUUAG |

TABLE II-continued

Human flt1 VEGF Receptor-Hammerhead Ribozyme and
Substrate Sequence

| nt. Position | HH Ribozyme | Substrate |
|---|---|---|
| 629 | CACUAAUA CUGAUGA X GAA AUAUAUAG | CUAUAUAUU UUUUACUG |
| 630 | UCACUAAU CUGAUGA X GAA AAUAUAUA | UAUAUAUUU AUUAGUGA |
| 631 | ACCACUAA CUGAUGA X GAA AAAUAUAU | AUAUAUUUA UUAGUGAU |
| 633 | GUAUCACU CUGAUGA X GAA AUAAAUAU | AUAUUAUUU AGUGAUAC |
| 634 | UGUAUCAC CUGAUGA X GAA AAUAAAUA | UAUUUAUUA GUGAUACA |
| 640 | UCUACCUG CUGAUGA X GAA AUCACUAA | UUAGUGAUA CAGGUAGA |
| 646 | GAAAGGUC CUGAUGA X GAA ACCUGUAU | AUACAGGUA GACCUUUC |
| 652 | CUCUACGA CUGAUGA X GAA AGGUCUAC | GUAGACCUU UCGUAGAG |
| 653 | UCUCUCUG CUGAUGA X GAA AAGGUCUA | UAGACCUUU CGUAGAGA |
| 654 | AUCUCUAC CUGAUGA X GAA AAAGGUCU | AGACCUUUC GUAGAGAU |
| 657 | UACAUCUC CUGAUGA X GAA ACGAAAGG | CCUUUCGUA GAGAUGUA |
| 665 | UUUCACUG CUGAUGA X GAA ACAUCUCU | AGAGAUGUA CAGUGAAA |
| 675 | AUUUCGGG CUGAUGA X GAA AUUUCACU | AGUGAAAUC CCCGAAAU |
| 684 | AGGUGUAU CUGAUGA X GAA AUUUGGGG | CCCGAAAUU AUACACAU |
| 685 | CAUGUGUA CUGAUGA X GAA AAUUUCGG | CCGAAAUUA UACACAUG |
| 687 | GUCAUGUG CUGAUGA X GAA AUAAUUUC | GAAAUUUUA CACAUGAC |
| 711 | GGAAUGAC CUGAUGA X GAA AGCUCCCU | AGGGAGCUC GUCAUUCC |
| 714 | CAGGGAAU CUGAUGA X GAA ACGAGCUC | GAGCUCGUC AUCCCUG |
| 717 | CGGCAGGG CUGAUGA X GAA AUGACGAG | CUCGUCAUU CCCUGCCG |
| 718 | CCGGCAGG CUGAUGA X GAA AAUGACGA | UCGUCAUUC CCUGCCGG |
| 729 | GGUGACCU CUGAUGA X GAA ACCCGGCA | UGCCGGGUU ACGUCACC |
| 730 | AGGUGACG CUGAUGA X GAA AACCCGGC | GCCGGGUUA CGUCACCU |
| 734 | UGUUAGGU CUGAUGA X GAA ACGUAACC | GGUUACGUC ACCUAACA |
| 739 | AGUGAUGU CUGAUGA X GAA AGGUGACG | CGUCACCUA ACAUCACU |
| 744 | GUAACAGU CUGAUGA X GAA AUGUUAGG | CCUAACAUC ACUGUUAC |
| 750 | UUUAAAGU CUGAUGA X GAA ACAGUGAU | AUCACUGUU ACUUUAAA |
| 751 | UUUUAAAG CUGAUGA X GAA AACAGUGA | UCACUGUUA CUUUAAAA |
| 754 | CUUUUUUA CUGAUGA X GAA ACUAACAG | CUGUUACUU UAAAAAG |
| 755 | ACUUUUUU CUGAUGA X GAA AAGUAACA | UGUUACUUU AAAAAGU |
| 756 | AACUUUUU CUGAUGA X GAA AAAGUAAC | GUUACUUUA AAAAGUU |
| 764 | CAAGUGGA CUGAUGA X GAA ACUUUUUU | AAAAAGUU UCCACUUG |
| 765 | UCAAGUGG CUGAUGA X GAA AACUUUUU | AAAAGUUU CCACUGGA |
| 766 | GUCAAGUG CUGAUGA X GAA AAACUUUU | AAAGUUUC CACUUGAC |
| 771 | AAAGUGUC CUGAUGA X GAA AGUGGAAA | UUCCACUU GACACUUU |
| 778 | AGGGAUCA CUGAUGA X GAA AGUGUCAA | UUGACACUU UGAUCCCU |
| 779 | CAGGGCUC CUGAUGA X GAA AAGUGUCA | UGACACUUU GAUCCCUG |
| 783 | CCAUCAGG CUGAUGA X GAA AYCAAAGU | ACUUUGAUC CCUGAUGG |

TABLE II-continued

Human flt1 VEGF Receptor-Hammerhead Ribozyme and Substrate Sequence

| nt. Position | HH Ribozyme | Substrate |
|---|---|---|
| 801 | UCCCAGAU CUGAUGA X GAA AUGCGUUU | AAACGCAUA AUCUGGGA |
| 804 | CUGUCCCA CUGAUGA X GAA AUUAUCUG | CGCAUAAUC UGGGACAG |
| 814 | GCCCUUUC CUGAUGA X GAA ACUGUCCC | GGGACAGUA GAAAGGGC |
| 824 | AUAUGAUG CUGAUGA X GAA AGCCCUUU | AAAGGGCUU CAUCAUAU |
| 825 | GAUAUGAU CUGAUGA X GAA AAGCCCUU | AAGGGCUUC AACAUAUC |
| 828 | UUUGAUAU CUGAUGA X GAA AUGAAGCC | GGCUUCAUC AUAUCAAA |
| 831 | GCAUUUGA CUGAUGA X GAA AUGAUGAA | UUCAUUCUA UCAAAUGC |
| 833 | UUGCAUUU CUGAUGA X GAA AUAUGAUG | CAUCAUAUC AAAUGCAA |
| 845 | UUUCUUUG CUGAUGA X GAA ACGUUGCA | UGCAACGUA CAAAGAAA |
| 855 | AGAACCCC CUGAUGA X GAA AUUUCUUU | AAAGAAAUA GGGCUUCU |
| 861 | CAGGUCAG CUGAUGA X GAA AGCCCUAU | AUAGGGCUU CUGACCUG |
| 862 | ACAGGUCA CUGAUGA X GAA AAGCCCUA | UAGGGCUUC UGACCUGU |
| 882 | UGCCCAUU CUGAUGA X GAA ACUGUUGC | GCAACAGUC AAUGGGCA |
| 892 | CUUAUACA CUGAUGA X GAA AUGCCCAU | AUGGGCAUU UGUAUAAG |
| 893 | UCUUAUAC CUGAUGA X GAA AAUGCCCA | UGGGCAUUU GUAUAAGA |
| 896 | UUGUCUUA CUGAUGA X GAA ACAAAUGC | GCAUUUGUA UAAGACAA |
| 898 | GUUUGUCU CUGAUGA X GAA AUACAAAU | AUUUGUAUA AGACAAAC |
| 908 | GUGUGAGA CUGAUGA X GAA AGUUUGUC | GACAAACUA UCUCACAC |
| 910 | AUGUGUGA CUGAUGA X GAA AUAGUUUG | CAAACUAUC UCACACAU |
| 912 | CGAUGUGU CUGAUGA X GAA AGAUAGUU | AACUAUCUC ACACAUCG |
| 919 | GGUUUGUC CUGAUGA X GAA AUGUGUGA | UCACACAUC GACAAACC |
| 931 | UAUGAUUG CUGAUGA X GAA AUUGGUUU | AAACCAAUA CAAUCAUA |
| 936 | ACAUCUAU CUGAUGA X GAA AUUGUAUU | AAUACAAUC AUAGAUGU |
| 939 | UGGACAUC CUGAUGA X GAA AUGAUUGU | ACAAUCAUA GAUGUCCA |
| 945 | CUUAUUUG CUGAUGA X GAA ACAUCUAU | AUAGAUGUC AAAUAAG |
| 951 | GGUGUGCU CUGAUGA X GAA AUUUGGAC | GUCCAAAUA AGCACACC |
| 969 | AGUAAUUU CUGAUGA X GAA ACUGGGCG | CGCCCAGUC AAAUUACU |
| 974 | CUCUAAGU CUGAUGA X GAA AUUUGACU | AGUCAAAUU ACUUAGAG |
| 975 | CCUCUAAG CUGAUGA X GAA AAUUUGAC | GUCAAAUUA CUUAGAGG |
| 978 | UGGCCUCU CUGAUGA X GAA AGUAAUUU | AAAUUACUU AGAGGCCA |
| 979 | AUGGCCUC CUGAUGA X GAA AAGUAAUU | AAUUACUUA GAGGCCAU |
| 988 | GACAAGAG CUGAUGA X GAA AUGGCCUC | GAGGCCAUA CUCUUGUC |
| 991 | GAGGACAA CUGAUGA X GAA AGUAUGGC | GCCAUACUC UUGUCCUC |
| 993 | UUGAGGAC CUGAUGA X GAA AGAGUAUG | CAUACUCUU GUCCUCAA |
| 996 | CAAUUGAG CUGAUGA X GAA ACAAGAGU | ACUCUUGUC CUCAAUUG |
| 999 | GUACAAUU CUGAUGA X GAA AGGACAAG | CUUGUCCUC AAUUGUAC |

TABLE II-continued

Human flt1 VEGF Receptor-Hammerhead Ribozyme and Substrate Sequence

| nt. Position | HH Ribozyme | Substrate |
|---|---|---|
| 1003 | AGCAGGAC CUGAUGA X GAA AUUGACGA | UCCUCAAUU GUACUGCU |
| 1006 | GGGAGCAG CUGAUGA X GAA ACAAUUGA | UCAAUUGUA CUGCUACC |
| 1012 | GGGAGUGG CUGAUGA X GAA AGCAGUAC | GUACUGCUA CCACUCCC |
| 1018 | GUUCAAGG CUGAUGA X GAA AGUGGUAG | CUACCACUC CCUUGAAC |
| 1022 | UCGUGUUC CUGAUGA X GAA AGGGAGUG | CACUCCCUU GAACACGA |
| 1035 | GUCAUUUG CUGAUGA X GAA ACUCUCGU | ACGAGAGUU CAAAUGAC |
| 1036 | GGUCAUUU CUGAUGA X GAA AACUCUCG | CGAGAGUUC AAAUGACC |
| 1051 | AUCAGGGU CUGAUGA X GAA ACUCCAGG | CCUGGAGUU ACCCUGAU |
| 1052 | CAUCAGGG CUGAUGA X GAA AACUCCAG | CUGGAGUUA CCCUGAUG |
| 1069 | AGCUCUCU CUGAUGA X GAA AUUUUUUU | AAAAAAAUA AGAGAGCU |
| 1078 | CCCUACGG CUGAUGA X GAA AGCUCUCU | AGAGAGCUU CCGUAAGG |
| 1079 | GCCUUACG CUGAUGA X GAA AAGCUCUC | GAGAGCUUC CGUAAGGC |
| 1083 | CGUCGCCU CUGAUGA X GAA ACGGAAGC | GCUUCCGUA AGGCGACG |
| 1095 | CUUUGGUC CUGAUGA X GAA AUUCGUCG | CGACGAAUU GACCAAAG |
| 1108 | GGCAUGGG CUGAUGA X GAA AUUGCUUU | AAAGCAAUU CCCAUGCC |
| 1109 | UGGCAUGG CUGAUGA X GAA AAUUGCUU | AAGCAAUUC CCAUGCCA |
| 1122 | CUGUAGAA CUGAUGA X GAA AUGUUGGC | GCCAACAUA UUCUACAG |
| 1124 | CACUGUAG CUGAUGA X GAA AUUUGUUG | CAACAUAUU CUACAGUG |
| 1125 | ACACUGUA CUGAUGA X GAA AAUAUAUU | AACAUAUUC UACAGUGU |
| 1127 | GAACACUG CUGAUGA X GAA AGAAUAUG | CAUAUUCUA CAGUGUUC |
| 1134 | AUAGUAAG CUGAUGA X GAA ACACUGUA | UACAGUGUU CUUACUAU |
| 1135 | AAUAGUAA CUGAUGA X GAA AACACUGU | ACAGUGUUC UUACUAUU |
| 1137 | UCAAUAGU CUGAUGA X GAA AGAACACU | AGUGUUCUU ACUAUUGA |
| 1138 | GUCAAUAG CUGAUGA X GAA AAGAACAC | GUGUUCUUA CUAUUGAC |
| 1141 | UUUGUCAA CUGAUGA X GAA ACUAAGAA | UUCUUACUA UUGACAAA |
| 1143 | AUUUGUC CUGAUGA X GAA AUAGUAAG | CUUACUAUU GACAAAAU |
| 1173 | CAACUAUA CUGAUGA X GAA AGUCCUUU | AAAGGACUU UUACUUG |
| 1174 | ACAAGCAU CUGAUGA X GAA AAGUCCUU | AAGGACUUU AUACUUGU |
| 1175 | GACAAGGA CUGAUGA X GAA AAAGUCCU | AGGACUUUA UACUUGUC |
| 1177 | ACGACAAG CUGAUGA X GAA AUAAAGUC | GACUUUAUA CUUGUCGU |
| 1180 | UACACGAC CUGAUGA X GAA AGUAUAAA | UUUAUACUU GUCGUGUA |
| 1183 | CCUUACAC CUGAUGA X GAA ACAAGUAU | AUACUUGUC GUGUAAGG |
| 1188 | CCACUCCU CUGAUGA X GAA ACACGACA | UGUCGUGUA AGGAGUGG |
| 1202 | AUUUGAAU CUGAUGA X GAA AUGGUCCA | UGGCUCUUC AUUCAAAU |
| 1205 | CAGAUUUG CUGAUGA X GAA AUGAUGGU | ACCAUCAUU CAAAUCUG |
| 1206 | ACAGAUUU CUGAUGA X GAA AAUGAUGG | CCAUCAUUC AAAUCUGU |
| 1211 | UGUUAACA CUGAUGA X GAA AUUUGAAU | AUUCAAAUC UGUUAACA |

TABLE II-continued

Human flt1 VEGF Receptor-Hammerhead Ribozyme and Substrate Sequence

| nt. Position | HH Ribozyme | Substrate |
|---|---|---|
| 1215 | GAGGUGUU CUGAUGA X GAA ACAGAUUU | AAAUCUGUU AACACCUC |
| 1216 | UGAGGUGU CUGAUGA X GAA AACAGAUU | AAUCUGUUA ACACCUCA |
| 1223 | UAUGCACU CUGAUGA X GAA AGGUGUGA | UAACACCUC AGUGCAUA |
| 1231 | AUCAUAUA CUGAUGA X GAA AUGGACUG | CAGUGCAUA UAUAUGAU |
| 1233 | UUAUCAUA CUGAUGA X GAA AUAUGCAC | GUGCAUAUA UAUGAUAA |
| 1235 | CUUUAUCA CUGAUGA X GAA AUAUAUGC | GCAUAUAUA UGAUAAAG |
| 1240 | GAAUGCUU CUGAUGA X GAA AUCAUAUA | UAUAUGAUA AAGCAUUC |
| 1247 | CAGUGAUG CUGAUGA X GAA AUGCUUUA | UAAAGCAUU CAUCACUG |
| 1248 | ACAGUGAU CUGAUGA X GAA AAUGCUUU | AAAGCAUUC AUAACUGU |
| 1251 | UUCACAGU CUGAUGA X GAA AUGAAUGC | GCAUUCAUC ACUGUGAA |
| 1264 | CUGUUUUC CUGAUGA X GAA AUGUUUCA | UGAAACAUC GAAAACAG |
| 1281 | ACGGUUUC CUGAUGA X GAA AGCACCUG | CAGGUGCUU GAAACCGU |
| 1290 | UUGCCAGC CUGAUGA X GAA ACGGUUUC | GAAACCGUA GCUGGCAA |
| 1304 | GCCGGUAA CUGAUGA X GAA ACCGCUUG | CAAGCGGUC UUACCGGC |
| 1306 | GAGCCGGU CUGAUGA X GAA AGACCGCU | AGCGGUCUU ACCGGCUC |
| 1307 | AGAGCCGG CUGAUGA X GAA AAGACCGC | GCGGUCUUA CCGGCUCU |
| 1314 | UUCAUAGA CUGAUGA X GAA AGCCGGUA | UACCGGCUC UCUAUGAA |
| 1316 | CUUUCAUA CUGAUGA X GAA AGAGCCGG | CCGGCUCUC UAUGAAAG |
| 1318 | CACUUUCA CUGAUGA X GAA AGAGAGCC | GGCUCUCUA UGAAAGUG |
| 1334 | GCGAGGGA CUGAUGA X GAA AUGCCUUC | GAAGGCAUU UCCCUCGC |
| 1335 | GGCGAGGG CUGAUGA X GAA AAUGCCUU | AAGGCAUUU CCCUCGCC |
| 1336 | CGGCGAGG CUGAUGA X GAA AAAUGCCU | AGGCAUUUC CCUCGCCG |
| 1340 | CUUCCGGC CUGAUGA X GAA AGGGAAAU | AUUUCCCUC GCCGGAAG |
| 1350 | AACCAUAC CUGAUGA X GAA ACUUGGGG | CCGGAAGUU GUAUGUUU |
| 1353 | UUUAACCA CUGAUGA X GAA ACAACUUC | GAAGUUUUA UGGUUAAA |
| 1358 | CAUCUUUU CUGAUGA X GAA ACCAUACA | UGUAUGGUU AAAAGAUG |
| 1359 | CCAUCUUU CUGAUGA X GAA AACCAUAC | GUAUGGUUA AAAGAUGG |
| 1370 | UCGCAGGU CUGAUGA X GAA ACCCAUCU | AGAUGGGUU ACCUGCGA |
| 1371 | GUCGCAGG CUGAUGA X GAA AACCCAUC | GAUGGGUUA CCUGCGAC |
| 1388 | AGCGAGCA CUGAUGA X GAA AUUUCUCA | UGAGAAAUC UGCUCGCU |
| 1393 | CAAAUAGC CUGAUGA X GAA AGCAGAUU | AAUCUGCUC GCUAUUUG |
| 1397 | GAGUCGAA CUGAUGA X GAA AGGGAGCA | UGCUCGCUA UUUGACUC |
| 1399 | ACGAGUCA CUGAUGA X GAA AUAGCGAG | CUGGCUAUU UGACUCGU |
| 1400 | CACGAGUC CUGAUGA X GAA AAUAGCGA | UCGCUAUUU GACUCGUG |
| 1405 | GUAGCCAC CUGAUGA X GAA AGUCAAAU | AUUUGACUC GUGGUUAC |
| 1412 | UUAACGAG CUGAUGA X GAA AGCCACGA | UCGUGGCUA CACGUUAA |

TABLE II-continued

Human flt1 VEGF Receptor-Hammerhead Ribozyme and Substrate Sequence

| nt. Position | HH Ribozyme | Substrate |
|---|---|---|
| 1415 | UAAUUAAC CUGAUGA X GAA AGUAGCGA | UGGCUACUC GUUAAUUA |
| 1418 | UGAUAAUU CUGAUGA X GAA ACGAGUAG | CUACUCGUU AAUUAUCA |
| 1419 | UUGAUAAU CUGAUGA X GAA AAGGAAUA | UACUCGUUA AUUAUCAA |
| 1422 | UCCUUGAU CUGAUGA X GAA AUUGACGA | UCGUCAAUU AUCAAGGA |
| 1423 | GUCCUUGA CUGAUGA X GAA AAUUAACG | CGUUAAUUA UCAAGGAC |
| 1425 | ACGUCCUU CUGAUGA X GAA AUAAUUAA | UUAAUUAUC AAGGAGGU |
| 1434 | UCUUCAGU CUGAUGA X GAA ACGUCCUU | AAGGACGUA ACUGAAGA |
| 1456 | GAUUGUAU CUGAUGA X GAA AUUCCCUG | CAGGGAAUU AUACAAUC |
| 1457 | AGAUUCCA CUGAUGA X GAA AAUUCCCU | AGGGAAUUA UACAAUCU |
| 1459 | CAAGAUUG CUGAUGA X GAA AUAAUUCC | GGAAUUAUA CAAUCUUG |
| 1464 | CUCAGCAA CUGAUGA X GAA AUUGUAUA | UAUACAAUC UUGCUGAG |
| 1466 | UGCUCAGC CUGAUGA X GAA AGAUUCUA | UACAAUCUU GCUGAGCA |
| 1476 | GACUGUUU CUGAUGA X GAA AUGCUCAG | CUCAGCAUA AAACAGUC |
| 1484 | ACACAUUU CUGAUGA X GAA ACUGUUUU | AAAACAGUC AAAUGUGU |
| 1493 | GGUUUUUA CUGAUGA X GAA ACACAUUU | AAAUGUGUU UAAAAACC |
| 1494 | AGGUUUUU CUGAUGA X GAA AACACAUU | AAUGUGUUU AAAAACCU |
| 1495 | GAGGUUUU CUGAUGA X GAA AAACACAU | AUGUGUUUA AAAACCUC |
| 1503 | GUGCAAAU CUGAUGA X GAA AGGUUUUU | AAAAACCUC ACUGCCAC |
| 1513 | GACAAUUA CUGAUGA X GAA AGUGGCAG | CUGCCACUC UAAUUGUC |
| 1515 | UUGACAAU CUGAUGA X GAA AGAGUGGC | GCCACUCUA AUUGUCAA |
| 1518 | ACAUUGAC CUGAUGA X GAA AUUAGAGU | ACUCUAAUU GUCAAUGU |
| 1521 | UUCAUUUU CUGAUGA X GAA ACAAUUAG | CUAAUUGUC AAUGUGAA |
| 1539 | UUUUCGUA CUGAUGA X GAA AUCUGGGG | CCCCAGAUU UACGAAAA |
| 1540 | CUUUUCGU CUGAUGA X GAA AAUGUGGG | CCCAGAUUU ACGAAAAG |
| 1541 | CCUUUUCG CUGAUGA X GAA AAAUCUGG | CCAGAUUUA CGAAAAGG |
| 1556 | GAAACGAU CUGAUGA X GAA ACACGGCC | GGCCGUGUC AUCGUUUC |
| 1559 | CUGGAAAC CUGAUGA X GAA AUGACACG | CGUGUCAUC GUUUCCAG |
| 1562 | GGUCUGGA CUGAUGA X GAA ACGAUGAC | GUCAUCGUU CCAGACC |
| 1563 | GGGUCUGG CUGAUGA X GAA AGCGAGGA | UCAUCGUUU CCAGACCC |
| 1564 | CGGGUCCG CUGAUGA X GAA AAACGAUG | CAUCGUUUC CAGACCCG |
| 1576 | UGGGCAGA CUGAUGA X GAA AGCCGGGU | ACCGGCUC UCCACCCA |
| 1578 | AGUGGGUA CUGAUGA X GAA AGAGCCGG | CCCCCUCUC UACCCACU |
| 1580 | CCAGUGGG CUGAUGA X GAA AGAGAGCC | GGCUCUCUA CCCACUGG |
| 1602 | CAAGUCAG CUGAUGA X GAA AUUUGUCU | AGACAAAUC CUGACUUG |
| 1609 | UGCGGUAC CUGAUGA X GAA AGUCAGGA | UCCUGACUU GUACCGCA |
| 1612 | AUAUGCGG CUGAUGA X GAA ACAAGUCA | UGACUUGUA CCGCAUAU |
| 1619 | GGAUACCA CUGAUGA X GAA AUGCGGUA | UACCGCAUA AGGUAUCC |

TABLE II-continued

| Human flt1 VEGF Receptor-Hammerhead Ribozyme and Substrate Sequence | | |
|---|---|---|
| nt. Position | HH Ribozyme | Substrate |
| 1624 | UUGAGGGA CUGAUGA X GAA ACCAUAUG | CAUAUGGUA UCCCUCAA |
| 1626 | GGUUGAGG CUGAUGA X GAA AUACCAUA | UAUGGUAUC CCUCAACC |
| 1630 | UGUAGGUU CUGAUGA X GAA AGGGAGAC | GUAUCCCUC AACCUCCA |
| 1636 | CUUGAUUG CUGAUGA X GAA AGGUUGAG | CUCAACCUA CAAUCAAG |
| 1641 | AACCACUU CUGAUGA X GAA AUUGUAGG | CCCACAAUC AAGUGGUU |
| 1649 | GGUGCCAG CUGAUGA X GAA ACCACUUG | CAAGUGGUU CUGGCACC |
| 1650 | GGGUGCCA CUGAUGA X GAA AACCACUU | AAGUGGUUC UGGCACCC |
| 1663 | AUUAUGGU CUGAUGA X GAA ACAGGGGU | ACCCCUGUA ACCAGAAU |
| 1669 | GGAAUGAU CUGAUGA X GAA AUGGUUAC | GUAACCAUA AUCAUUCC |
| 1672 | UUCGGAAU CUGAUGA X GAA AUUAUGGU | ACCAUAAUC AUUCCGAA |
| 1675 | UGCUUCGG CUGAUGA X GAA AUGAUUAU | AUAAUCAUU CCGAAGCA |
| 1676 | UUGCUUCG CUGAUGA X GAA AAUGAUUA | UAAUCAUUC CGAAGCAA |
| 1694 | UGGAACAA CUGAUGA X GAA AGUCACAC | GUGUGACUU UUGUUCCA |
| 1695 | UUGGAACA CUGAUGA X GAA AAGUCACA | UGUGACUUU UGUUCCAA |
| 1696 | AUUGGAAC CUGAUGA X GAA AAAGUCAC | GUGACUUUU GUUCCAAU |
| 1699 | AUUAUUGG CUGAUGA X GAA ACAAAAGU | ACUUUUGUU CCAAUAAU |
| 1700 | CAUUAUUG CUGAUGA X GAA AACAAAAG | CUUUUGUUC CAAUAAUG |
| 1705 | CUCUUCAU CUGAUGA X GAA AUUGGAAC | GUUCCAAUA AUGAAGAG |
| 1715 | GGAUAAAG CUGAUGA X GAA ACUCUUCA | UGAAGAGUC CUUUAUCC |
| 1718 | CCAGGAUA CUGAUGA X GAA AGGACUCU | AGAGUCCUU UAUCCUGG |
| 1719 | UCCAGGAU CUGAUGA X GAA AAGGACUC | GAGUCCUUU AUCCUGGA |
| 1720 | AUCCAGGA CUGAUGA X GAA AAAGGACU | AGUCCUUUA UCCUGGAU |
| 1722 | GCAUCCAG CUGAUGA X GAA AUAAAGGA | UCCUUUAUC CUGGAUGC |
| 1755 | AUGCUCUC CUGAUGA X GAA AUUCUGUU | AACAGAAUU GAGAGCAU |
| 1764 | CGCUGAGU CUGAUGA X GAA AUGCUCUC | GAGAGCAUC ACUCAGCG |
| 1768 | CAUGCGCU CUGAUGA X GAA AGUGAGGC | CCAUCACUC AGCGCAUG |
| 1782 | CCUUCUAU CUGAUGA X GAA AUUGCCAU | AUGGCAAUA AUAGAAGG |
| 1785 | UUUCCUUC CUGAUGA X GAA AUUAUUGC | GCAAUAAUA GAAGGAAA |
| 1798 | AGCCAUCU CUGAUGA X GAA AUUCUUUC | GAAAGAAUA AGAUGGCU |
| 1807 | CAAGGUGC CUGAUGA X GAA AGCCAUCU | AGAUGGCUA GCACCUUG |
| 1814 | CCACAACC CUGAUGA X GAA AGGUGCUA | UAGCACCUU GGUUGUGG |
| 1818 | UCAGCCAC CUGAUGA X GAA ACCAAGGU | ACCUUGGUU GUGGCUGA |
| 1829 | AAAUUCUA CUGAUGA X GAA AGUCAGCC | GGCUGACUC UAGAAUUU |
| 1831 | AGAAAUUC CUGAUGA X GAA AGAGUCAG | CUGACUCUA GAAUUUCU |
| 1836 | AUUCCAGA CUGAUGA X GAA AUUCUAGA | UCUAGAAUU UCUGGAAU |
| 1837 | GAUUCCAG CUGAUGA X GAA AAUUCUAG | CUAGAAUUU CUGGAAUC |

TABLE II-continued

Human flt1 VEGF Receptor-Hammerhead Ribozyme and Substrate Sequence

| nt. Position | HH Ribozyme | Substrate |
|---|---|---|
| 1838 | AGAUUCCA CUGAUGA X GAA AAAUUCCA | UAGAAUUUC UGGAAUCU |
| 1845 | CAAAUGUA CUGAUGA X GAA AUUCCAGA | UCUGGAAUC UACAUUUG |
| 1847 | UGCAAAUG CUGAUGA X GAA AGAUUCCA | UGGAAUCUA CAUUUGCA |
| 1851 | GCUAUGCA CUGAUGA X GAA AUGUAGAU | AUCUACAUU UGCAUAGC |
| 1852 | AGCUAUGC CUGAUGA X GAA AAUGUAGA | UCUACAUUU GCAUAGCU |
| 1857 | UUGGAAGC CUGAUGA X GAA AUGCAAAU | AUUUGCAUA GCUUCCAA |
| 1861 | UUUAUUGG CUGAUGA X GAA AGCGAUGC | GCAUAGCUU CCAAUAAA |
| 1862 | CUUUAUUG CUGAUGA X GAA AAGCUAUG | CAUAGCUUC CAAUAAAG |
| 1867 | CCCAACUU CUGAUGA X GAA AUUAGAAG | CUUCCAAUA AAGUUGGG |
| 1872 | ACAGUCCC CUGAUGA X GAA ACUUUAUU | AAUAAAGUU GGGACUGU |
| 1893 | UAAAAGCU CUGAUGA X GAA AUGUUUCU | AGAAACAUA AGCUUUUA |
| 1898 | UGAUAUAA CUGAUGA X GAA ACCUCAUG | CAUAAGCUU UUAUAUCA |
| 1899 | GUGAUAUA CUGAUGA X GAA AAGCUUAU | AUAAGCUUU UAUAUCAC |
| 1900 | UGUGAUAU CUGAUGA X GAA AAAGCUUA | UAAGCUUUU AUAUCACA |
| 1901 | CUGUGAUA CUGAUGA X GAA AAAAGCUU | AAGCUUUUA UAUCACAG |
| 1903 | AUCUGUGA CUGAUGA X GAA AUAAAAGC | GCUUUUACA UCACAGAU |
| 1905 | ACAUCUGU CUGAUGA X GAA AUAUAAAA | UUUUUAUC ACAGAUGU |
| 1925 | UAACAUGA CUGAUGA X GAA ACCCAUUU | AAAUGGGUU UCAUGUUA |
| 1926 | UUAACAUG CUGAUGA X GAA AACCCAUU | AAUGGGUUU CAUGUUAA |
| 1927 | GUUAACAU CUGAUGA X GAA AAACCCAU | AUGGGUUUC AUGUUAAC |
| 1932 | UCCAAGUU CUGAUGA X GAA ACAUGAAA | UUUCAUAAU AACUUGGA |
| 1933 | UUCCCAGU CUGAUGA X GAA AACAUGAA | UUCAUGUUA ACUUGGAA |
| 1937 | UUUUUUCC CUGAUGA X GAA AGUUAACA | UGUUAACUU UGUUAACU |
| 1976 | CUGUGCAA CUGAUGA X GAA ACAGUUUC | GAAACUGUC UUGCACAG |
| 1378 | AACUGUGC CUGAUGA X GAA AGACAGUU | AACUGUCUU GCACAGUU |
| 1986 | AACUUGUU CUGAUGA X GAA ACUGUGCA | UGCACAGUU AACAAGUU |
| 1987 | GAACUAAU CUGAUGA X GAA AACUGUGC | GCACAGUUA ACAAGUUC |
| 1994 | UGUAUAAG CUGAUGA X GAA ACUUGUUA | UAACAAGUU CUUAUACA |
| 1995 | CUGUAUAA CUGAUGA X GAA AACUUGUU | AACAAGUUC UUUAUACAG |
| 1997 | CUCUGUAU CUGAUGA X GAA AGAACUUG | CAAGUUCUU AUACAGAG |
| 1998 | UCUCUGUA CUGAUGA X GAA AAGAACUU | AAGUUCUUA UACAGAGA |
| 2000 | CGUCUCUG CUGAUGA X GAA AUAAAGAC | GUUCUUAUA CAGAGACG |
| 2010 | AUCCAAGU CUGAUGA X GAA ACCUCUCU | AGAGACGUU ACUUGGAU |
| 2011 | AAUCCAAG CUGAUGA X GAA AACGUCUC | GAGACGUUA CUUGGAUU |
| 2014 | UAAAAUCC CUGAUGA X GAA AGUAACGU | ACGUUACUU GGAUUUUA |
| 2019 | CGCAGUAA CUGAUGA X GAA AUCCAAGU | ACUUGGAUU UUACUGCG |
| 2020 | CCGCAGUA CUGAUGA X GAA AAUCCAAG | CUUGGAUUU UACUGCGG |

TABLE II-continued

Human flt1 VEGF Receptor-Hammerhead Ribozyme and Substrate Sequence

| nt. Position | HH Ribozyme | Substrate |
|---|---|---|
| 2021 | UCCGCAGU CUGAUGA X GAA AAAUCCCA | UUGGAUUUU ACUGCGGA |
| 2022 | GUCCACAG CUGAUGA X GAA AAAAUCCA | UGGAUUUUA CUGCGGAC |
| 2034 | CUGUUAUU CUGAUGA X GAA ACUGUCCG | CGGACAGUU AAUAACAG |
| 2035 | UCUGUUAU CUGAUGA X GAA AACUGUCC | GGACAGUUA AUAACAGA |
| 2038 | UGUUCUGU CUGAUGA X GAA AUUAACUG | CAGUUAAUA ACAGAACA |
| 2054 | UAAUACUG CUGAUGA X GAA AGUGCAUU | AAUGCACUA CAGUAUUA |
| 2059 | CUUGCUAA CUGAUGA X GAA ACUGUAGU | ACUACAGUA UUAGCAAG |
| 2061 | UGCUUGCU CUGAUGA X GAA AUACUGUA | UACAGUAUU AGCAAGCA |
| 2062 | UUGCUUGC CUGAUGA X GAA AAUACUGU | ACAGUAUUA GCAAGCAA |
| 2082 | UCCUUAGU CUGAUGA X GAA AUGGCCAU | AUGGCCAUC ACUAAGGA |
| 2086 | GUGCUCCU CUGAUGA X GAA AGUGAUGG | CCAUCACUA AGGAGCAC |
| 2096 | GAGUGCUG CUGAUGA X GAA AGUGCUCC | GGAGCACUC CAUCACUC |
| 2100 | UUAAGAGU CUGAUGA X GAA AUGGAGUG | CACUCCAUC ACUCUUAA |
| 2104 | AAGAUUAA CUGAUGA X GAA AGUGAUGG | CCAUCACUC UUAAUCUU |
| 2106 | GUAAGAUU CUGAUGA X GAA AGAGUGAU | AUCACUCUU AAUCUUAC |
| 2107 | GGUAAGAU CUGAUGA X GAA AAGAGUGA | UCACUCUUA AUCUUACC |
| 2110 | GAUGGGAA CUGAUGA X GAA AUUAAGAG | CUCUUAAUC UUACCAUC |
| 2112 | AUGAUGGU CUGAUGA X GAA AGAUUAAG | CUUAAUCUU ACCAUCAU |
| 2113 | CAUGAUGG CUGAUGA X GAA AAGAUUAA | UUAAUCUUA CCAUCAUG |
| 2118 | ACAUUCAU CUGAUGA X GAA AUGGUAAG | CUUACCAUC AUGAAUGU |
| 2127 | UGCAGGGA CUGAUGA X GAA ACAUUCAU | AUGAAUGUU UCCCUGCA |
| 2128 | UUGCAGGG CUGAUGA X GAA AACAUUCA | UGAAUGUUU CCCUGCAA |
| 2129 | CUUGCAGG CUGAUGA X GAA AAACAUUC | GAAUGUUUC CUGCAAG |
| 2140 | GGUGCCUG CUGAUGA X GAA AUCUUGCA | UGCAAGAUU CAGGCACC |
| 2141 | AGGUGUCU CUGAUGA X GAA AAUCUUGC | GCAAGAUUC AGGCACCU |
| 2150 | UGCAGGCA CUGAUGA X GAA AGGUGCCU | AGGCACCUA UGCCUGCA |
| 2172 | CCUGUCCA CUGAUGA X GAA ACAUUCCU | AGGAAUGUA UACACAGG |
| 2174 | CCCCUGUG CUGAUGA X GAA AUACAUUC | GAAUUUAUA CACAGGOG |
| 2190 | UUCUGAGG CUGAUGA X GAA AUUCCUUC | GAAGAAAUC CUCCAGAA |
| 2193 | UUCUUCUG CUGAUGA X GAA AGGAUUUC | GAAAUCCUC CAGAAGAA |
| 2208 | CUGAUUGU CUGAUGA X GAA AUUUCUUU | AAAGAAAUU ACAAUCAG |
| 2209 | UCUGAUUG CUGAUGA X GAA AAUUUCUU | AAGAAAUUA CAAUCAGA |
| 2214 | UGAUCUCU CUGAUGA X GAA AUUGUAAU | AUUACAAUC AGAGAUCA |
| 2221 | UGCUUCCU CUGAUGA X GAA AUCUCUGA | UCAGAGAUC AGGAAGCA |
| 2234 | GCAGGAGG CUGAUGA X GAA AUGGUGCU | AGCACCAUA CCUCCUGC |
| 2238 | UUUCGCAG CUGAUGA X GAA AGGUAUGG | CCAUACCUC CUGCGAAA |

TABLE II-continued

Human flt1 VEGF Receptor-Hammerhead Ribozyme and Substrate Sequence

| nt. Position | HH Ribozyme | Substrate |
|---|---|---|
| 2250 | UGAUCACU CUGAUGA X GAA AGGUUUCG | CGAAACCUC AGUGAUCA |
| 2257 | CACUGUGU CUGAUGA X GAA AUCACUGA | UCAGUGAUC ACACAGUG |
| 2271 | GAACUGCU CUGAUGA X GAA AUGGCCAC | GUGGCCAUC AGCAAUUC |
| 2278 | AGUGGUGG CUGAUGA X GAA ACUGCUGA | UCAGCAGUU CCACCACU |
| 2279 | AAGUGGUG CUGAUGA X GAA AACAGCUG | CAGCAGUUC CACCACUU |
| 2287 | ACAGUCUA CUGAUGA X GAA AGUGGUGG | CCACCACUU UAGACUGU |
| 2288 | GACAGUCU CUGAUGA X GAA AAGUGGUG | CACCACUUU AGACUGUC |
| 2289 | UGACAGUC CUGAUGA X GAA AAAGUGGU | ACCACUUUA GACUGUCA |
| 2296 | AUUAGCAU CUGAUGA X GAA ACAGUCUA | UAGACUGUC AUGCUAAU |
| 2302 | GACACCAU CUGAUGA X GAA AGCAUGAC | GUCAUGCUA AUGGUGUC |
| 2310 | GGCUCGGG CUGAUGA X GAA ACACCAUU | AAUGGUGUC CCCGAGCC |
| 2320 | AGUGAUCU CUGAUGA X GAA AGCCUUGG | CCGAGCCUC AGAUCACU |
| 2325 | AACCAAGU CUGAUGA X GAA AUCUGAGG | CCUCAGAUC ACUUGGUU |
| 2329 | UUUAAAUC CUGAUGA X GAA AGUGAUCU | AGAUCACUU GGUUUAAA |
| 2333 | UGUUUUGA CUGAUGA X GAA ACCAAGUG | CACUUGGUU UAAAAACA |
| 2334 | UUGUUUUU CUGAUGA X GAA AACCAAGU | ACUUGGUUU AAAAACAA |
| 2335 | GUUGUUUU CUGAUGA X GAA AAACCAAG | CUUGGUUUA AAAGAAC |
| 2352 | UCUUGUUG CUGAUGA X GAA AUUUUGUG | CACAAAAUA CAACAAGA |
| 2370 | CCUAAAAU CUGAUGA X GAA AUUCCAGG | CCUGGAAUU AUUUUAGG |
| 2371 | UCCUAAAA CUGAUGA X GAA AAUUCCAG | CUGGAAUUA UUUUAGGA |
| 2373 | GGUCCUAA CUGAUGA X GAA AUAAUUCC | GGAAUUAUU UUAGGACC |
| 2374 | UGGUCCUA CUGAUGA X GAA AAUAAUUC | GAAUUAUUU UAGGACCA |
| 2375 | CUGGUCCU CUGAUGA X GAA AAAUAAUU | AAUUAUUUU AGGACCAG |
| 2376 | CCUGGUCC CUGAUGA X GAA AAAAUAAU | AUUAUUUUA GGACCAGG |
| 2399 | UUUCAAUA CUGAUGA X GAA ACAGCGUG | CACGCUGUU UAUUGAAA |
| 2400 | CUUUCAAU CUGAUGA X GAA AACAGCGU | ACGCUGUUU AUUGAAAG |
| 2401 | UCUUUCAA CUGAUGA X GAA AAACAGCG | CGCUGUUUA UUGAAAGA |
| 2403 | ACUCUUUC CUGAUGA X GAA AUAAACAG | CUGUUUAUU GAAAGAGU |
| 2412 | UCUUCUGU CUGAUGA X GAA ACUCUUUC | GAAAGAGUC ACAGAAGA |
| 2433 | CAGUGAUA CUGAUGA X GAA ACACCUUC | GAAGGUGUC UAUCACUG |
| 2435 | UGCAGUGA CUGAUGA X GAA AGACACCU | AGGUGUCUA UCACUGCA |
| 2437 | UUUGCAGU CUGAUGA X GAA AUAGACAC | GUGUCUAUC ACUGCAAA |
| 2465 | UUUCCACA CUGAUGA X GAA AGCCCUUC | GAAGGGCUC UGUGGAAA |
| 2476 | GUAUGCUG CUGAUGA X GAA ACUUUCCA | UGGAAAGUU CAGCAUAC |
| 2477 | GGUAUGCU CUGAUGA X GAA AACUUUCC | GGAAAGUUC AGCAUACC |
| 2483 | CAGUGAGG CUGAUGA X GAA AUGCUGAA | UUCAGCAUA CCUCACUG |
| 2487 | UGAACAGU CUGAUGA X GAA AGGUAUGC | GCAUACCUC ACUGUUCA |

TABLE II-continued

Human flt1 VEGF Receptor-Hammerhead Ribozyme and Substrate Sequence

| nt. Position | HH Ribozyme | Substrate |
|---|---|---|
| 2493 | GUUCCUUG CUGAUGA X GAA ACAGUGAG | CUCACUGUU CAAGGAAC |
| 2494 | GGUUCCUU CUGAUGA X GAA AACAGUGA | UCACUGUUC AAGGAACC |
| 2504 | ACUUGUCC CUGAUGA X GAA AGGUUCCU | AGGAACCUC GGACAAGU |
| 2513 | CCAGAUUA CUGAUGA X GAA ACUUGUCC | CGACAAGUC UAAUCUOG |
| 2515 | CUCCAGAU CUGAUGA X GAA AGACUUGU | ACAAGUCUA AUCGGAG |
| 2518 | CAGCUCCA CUGAUGA X GAA AUUAGACU | AGUCUAAUC UGGAGCUG |
| 2529 | GUUAGAGU CUGAUGA X GAA AUCAGCUC | GAGCUGAUC ACUCUAAC |
| 2533 | GCAUGUUA CUGAUGA X GAA AGUGAUCA | UGAUCACUC UAACAUGC |
| 2535 | GUGCAUGU CUGAUGA X GAA AGAGUGAU | AUCACUCUA ACAUGCAC |
| 2560 | CCAGAAGA CUGAUGA X GAA AGGUCGAG | CUCCGACUC UCUUCUCG |
| 2562 | AGCCAGAA CUGAUGA X GAA AGAGUUUC | GCGACUCUC UUCUGGCU |
| 2564 | GGAGCCAG CUGAUGA X GAA AGAGAGUC | GACUCUCUU CUGGCUCC |
| 2565 | AGGAGCCA CUGAUGA X GAA AAGAGAGU | ACUCUCUUC UGGCUCCU |
| 2571 | GUUAAUAG CUGAUGA X GAA AGCCAGAA | UUCUGGCUC CUAUUAAC |
| 2574 | AGGGUUAA CUGAUGA X GAA AGGAGCCA | UGGCUCCUA UUAACCCU |
| 2576 | GGAGGGUU CUGAUGA X GAA AUAGGAGC | GCUCCUAUU AACCCUCC |
| 2577 | AGGAGGGU CUGAUGA X GAA AAUAGGAG | CUCCUAUUA ACCUCUCU |
| 2583 | CGGAUAAG CUGAUGA X GAA AGGGUGAA | UUAACCCUC CUUAUCCG |
| 2586 | UUUCGGAU CUGAUGA X GAA AGGAGGGU | ACCCUCCUU AUCCGAAA |
| 2587 | UUUUCGGA CUGAUGA X GAA AAGGAGGG | CCCUCCUUA UCCGAAAA |
| 2589 | AUUUUUCG CUGAUGA X GAA AUAAGGAG | CUCCUUAUC CGAAAAAU |
| 2606 | CAAAAGAA CUGAUGA X GAA ACCUUUUC | GAAAAGGUC UUCUUCUG |
| 2608 | UUCAGAAG CUGAUGA X GAA AGACCUUU | AAAGGUCUU CUUCUGAA |
| 2609 | UUCCAGAA CUGAUGA X GAA AAGACCUU | AAGGUCUUC UUCUGAAA |
| 2611 | UAUUUCAG CUGAUGA X GAA AGAAGACC | GGUCUUCUU CUGAAAUA |
| 2612 | UUAUUUCA CUGAUGA X GAA AAGAAGAC | GUCUUCUUC UGAAAUAA |
| 2619 | UCAGUCUU CUGAUGA X GAA AUUUCAGA | UCUGAAAUA AAGACUGA |
| 2630 | UUGAUAGG CUGAUGA X GAA AGUCAGUC | GACUGAAUA CCUAUCAA |
| 2634 | AUAAUUGA CUGAUGA X GAA AGGUAGUC | GACUACCUA UCAAUUAU |
| 2636 | UUAUAAUU CUGAUGA X GAA AUAGGUAG | CUACCUAUC AAUUAUAA |
| 2640 | UCCAUUAU CUGAUGA X GAA AUUGAUAG | CUAUCAAUU AUAAUCGA |
| 2641 | GUCCAUUA CUGAUGA X GAA AAUUGAUA | UAUCAAUUA UAAUGGAC |
| 2643 | CGGUCCAU CUGAUGA X GAA AUAAUUGA | UCAAUUAUA AUGGACCC |
| 2661 | UCCAAAGG CUGAUGA X GAA ACUUCAUC | GAUGAAGUU CCUUUGGA |
| 2662 | AUCCAAAG CUGAUGA X GAA AACUUCAU | AUGAAGUUC CUUUGGAU |
| 2665 | CUCAUCCA CUGAUGA X GAA AGGAACUU | AAGUUCCUU UGGAUGAG |

TABLE II-continued

Human flt1 VEGF Receptor-Hammerhead Ribozyme and Substrate Sequence

| nt. Position | HH Ribozyme | Substrate |
|---|---|---|
| 2666 | GCUCAUCC CUGAUGA X GAA AAGGAACU | AGUUCCUUU GGAUGAGC |
| 2688 | UCAUAAGG CUGAUGA X GAA AGCCGCUC | GAGCGGCUC CCUUAUGA |
| 2692 | GGCAUCAU CUGAUGA X GAA AGGGAGCC | GGCUCCCUU AUGAUCCC |
| 2693 | UGGCAUCA CUGAUGA X GAA AAGGGAGC | GCUCCCUUA UGAUGCCA |
| 2714 | CCCGGGCA CUGAUGA X GAA ACUCCCAC | GUGGGAGUU UGCCCGGG |
| 2715 | UCCCGGGC CUGAUGA X GAA AACUCCCA | UGGGAGUUU GCCCGGGA |
| 2730 | CCCAGUUU CUGAUGA X GAA AGUCUCUC | GAGAGACUU AAACUGGG |
| 2731 | GCCCAGUU CUGAUGA X GAA AAGUCUCU | AGAGACUUA AACUGGGC |
| 2744 | UUCCAAGU CUGAUGA X GAA AUUUGCCC | GCCCAAAUC ACUUGGAA |
| 2748 | CCUCUUCC CUGAUGA X GAA AGUGAUUU | AAAUCACUU GGAAGAGG |
| 2761 | UUUUCCAA CUGAUGA X GAA AGCCCCUC | GAGGGGGUU UUGGAAAA |
| 2762 | CUUUUCCA CUGAUGA X GAA AAGCCCCU | AGGGGCUUU UGGAAAAG |
| 2763 | ACUUUUCC CUGAUGA X GAA AAAGCCCC | GGGGCUUUU GGAAAAGU |
| 2775 | GAUGCUUG CUGAUGA X GAA ACCACUUU | AAAGUGGUU CAAGCACC |
| 2776 | UGAUGCUU CUGAUGA X GAA AACCACUU | AAGUGGUUC AAGCAUCA |
| 2783 | CAAAUGCU CUGAUGA X GAA AUGCUUGA | UCAAGCAUC AGCAUUUG |
| 2789 | UAAUGCCA CUGAUGA X GAA AUGCUGAU | AUCAGCAUU UGGCAUUA |
| 2790 | UUAAUGCC CUGAUGA X GAA AAUGCUGA | UCAGCAUUU GCCAUUAA |
| 2796 | GAUUUCUU CUGAUGA X GAA AUGCCAAA | UUUGGCAUU AAGAAAUC |
| 2797 | UGAUUUCU CUGAUGA X GAA AAUGCCAA | UUGGCAUUA AGAAAUCA |
| 2804 | ACGUAGGU CUGAUGA X GAA AUUUCUUA | UAAGAAAUC ACCUACGU |
| 2809 | CCGGCACG CUGAUGA X GAA AGGUGAUU | AAUCACCUA CGUGCCGG |
| 2864 | GAGCUUUG CUGAUGA X GAA ACUCCCUG | CAGCGAGUA CAAAGCUC |
| 2872 | AGUCAUCA CUGAUGA X GAA AGCUUUGU | ACAAAGCUC UGAUGACU |
| 2886 | AAGAUUUU CUGAUGA X GAA AGCUCAGU | ACUGAGCCA AAAAUCUU |
| 2892 | UGGGUCAA CUGAUGA X GAA AUUUUUAG | CUAAAAAUC UUGACOCA |
| 2894 | UGUGGGUC CUGAUGA X GAA AGAUUUUU | AAAAAUCUU GACCCACA |
| 2904 | UGGUGGCC CUGAUGA X GAA AUGUGGGU | ACCCACAUU GGCCACCA |
| 2914 | CACGUUCA CUGAUGA X GAA AUGGUGGC | GCCACCAUC UGAACGUG |
| 2925 | AGCAGGUU CUGAUGA X GAA ACCACGUU | AACGUGGUU AACCUGCU |
| 2926 | CAGCAGGU CUGAUGA X GAA AACCACGU | ACGUGGUUA ACCUGCUG |
| 2962 | CACCAUCA CUGAUGA X GAA AGGCCCUC | GAGGGCCUC UGAUGGUG |
| 2973 | UAUUCAAC CUGAUGA X GAA AUCACCAU | AUGGUGAUU GUUGAAUA |
| 2976 | CAGUAUUC CUGAUGA X GAA ACAAUCAC | GUGAUUGUU GAAUACUG |
| 2981 | AUUUGCAG CUGAUGA X GAA AUUCAACA | UGUUGAAUA CUGCAAAU |
| 2990 | GAUUUCCA CUGAUGA X GAA AUUUGCAG | CUGCAAAUA UGGAAAUC |
| 2998 | GUUGGAGA CUGAUGA X GAA AUUUCCAU | AUGGAAAUC UCUCCAAC |

TABLE II-continued

Human flt1 VEGF Receptor-Hammerhead Ribozyme and Substrate Sequence

| nt. Position | HH Ribozyme | Substrate |
|---|---|---|
| 3000 | UAGUUGGA CUGAUGA X GAA AGAUUUCC | GGAAAUCUC UCCAACUA |
| 3002 | GGUAGUUG CUGAUGA X GAA AGAGAUUU | AAAUCUCUC CAACUACC |
| 3008 | UCUUGAGG CUGAUGA X GAA AGUUGGAG | CUCCAACUA CCUCAAGA |
| 3012 | UUGCUCUU CUGAUGA X GAA AGGUAGUU | AACUACCUC AAGAGCAA |
| 3029 | GAAAAAAU CUGAUGA X GAA AGUCACGU | ACGUGACUU AUUUUUUC |
| 3030 | AGAAAAAA CUGAUGA X GAA AAGUCACG | CGUGACUUA UUUUUUCU |
| 3032 | UGAGAAAA CUGAUGA X GAA AUAAGUCA | UGACUUAUU UUUCUCA |
| 3033 | UUGAGAAA CUGAUGA X GAA AAUAAGUC | GACUUAUUU UUUCUCAA |
| 3034 | GUUGAGAA CUGAUGA X GAA AAAUAAGU | ACUUAUUUU UUCUCAAC |
| 3035 | UGUUGAGA CUGAUGA X GAA AAAAUAAG | CUUAUUUUU UCUCAACA |
| 3036 | UUGUUGAG CUGAUGA X GAA AAAAAUAA | UUAUUUUUU CUCAACAA |
| 3037 | CUUGUUGA CUGAUGA X GAA AAAAAAUA | UAUUUUUUC UCAACAAG |
| 3039 | UCCUUGUU CUGAUGA X GAA AGAAAAAA | UUUUUUCUC AACAAGGA |
| 3057 | UCCAUGUG CUGAUGA X GAA AGUGCUGC | GCAGCACUA CACAUGGA |
| 3070 | UUCUUUCU CUGAUGA X GAA AGGCUCCA | UGGAGCCUA AGAAAGAA |
| 3120 | ACGCUAUC CUGAUGA X GAA AGUCUUGG | CCAAGACUA GAUAGCGU |
| 3124 | GGUGACGC CUGAUGA X GAA AGCUAGUC | GACUAGAUA GCGUCACC |
| 3129 | CUGCUGGU CUGAUGA X GAA ACGCUAUC | GAUAGCGUC ACCAGCAG |
| 3146 | AGCUCGCA CUGAUGA X GAA AGCUUUCG | CGAAAGCUU UGCGAGCU |
| 3147 | GAGCUCGC CUGAUGA X GAA AAGCUUUC | GAAAGCUUU GCGAGCUC |
| 3155 | GAAAGCCG CUGAUGA X GAA AGCUCGCA | UGCGAGCUC CGGCUUUC |
| 3161 | CUUCCUGA CUGAUGA X GAA AGCCGGAG | CUCCGGCUU UCAGGAAG |
| 3162 | UCUUCCUG CUGAUGA X GAA AAGCCGGA | UCCGGCUUU CAGGAAGA |
| 3163 | AUCUUCCU CUGAUGA X GAA AAAGCCGG | CCGGCUUUC AGGAAGAU |
| 3172 | CAGACUUU CUGAUGA X GAA AUCUUCCU | AGGAAGAUA AAAGUCUG |
| 3178 | AUCACUCA CUGAUGA X GAA ACUUUUAU | AUAAAAGUC UGAGUGAU |
| 3189 | UCUUCCUC CUGAUGA X GAA ACAUCACU | AGUGAUGUU GAGGAAGA |
| 3205 | ACCGUCAG CUGAUGA X GAA AUCCUCCU | AGGAUGAUU CUUGACGU |
| 3206 | AACCGUCA CUGAUGA X GAA AUCCUCC | GGAGGAUUC UGACGGUU |
| 3214 | CUUGUAGA CUGAUGA X GAA ACCGUCAG | CUGACGGUU UCUACAAG |
| 3215 | CCUUGCAG CUGAUGA X GAA AACCGUCA | UGACGGUUU CUACAAGG |
| 3216 | UCCUUGUA CUGAUGA X GAA AAACCGUC | GACGGUUUC UACAAGGA |
| 3218 | GCUCCUUG CUGAUGA X GAA AGAAACCG | CGGUUUCUA CAAGGAGC |
| 3231 | UCCAAAGU CUGAUGA X GAA AUGGGCUC | GAGCCCAUC ACUAUGGA |
| 3235 | AUCUUCCA CUGAUGA X GAA AGUGAUGG | CCAUCACUA UGGAAGAU |
| 3244 | AGAAAUCA CUGAUGA X GAA AUCUUCCA | UGGAAGAUC UGAUUUCU |

TABLE II-continued

Human flt1 VEGF Receptor-Hammerhead Ribozyme and Substrate Sequence

| nt. Position | HH Ribozyme | Substrate |
|---|---|---|
| 3249 | CUGUAAGA CUGAUGA X GAA AUCAGAUC | GAUCUGAUU UCUUACAG |
| 3250 | ACUGUAAG CUGAUGA X GAA AAUCAGAU | AUCUGAUUU CUUACAGU |
| 3251 | AACUGUAA CUGAUGA X GAA AAAUCAGA | UCUGAUUUC UUACAGUU |
| 3253 | AAAACUGU CUGAUGA X GAA AGAAAUCA | UGAUUUCUU ACAGUUUU |
| 3254 | GAAAACUG CUGAUGA X GAA AAGAAAUC | GAUUUCUUA CAGUUUUC |
| 3259 | CACUUGAA CUGAUGA X GAA ACUGUAAG | CUUACAGUU UUCAAGUG |
| 3260 | CCACUUGA CUGAUGA X GAA AACUGUAA | UUACAGUUU UCAAGUGG |
| 3261 | GCCACUUG CUGAUGA X GAA AAACUGUA | UACAGUUUU CAAGUGGC |
| 3262 | GGCCACUU CUGAUGA X GAA AAAACUGU | ACAGUUUUC AAGUGGCC |
| 3284 | AAGACAGG CUGAUGA X GAA ACUCCAUG | CAUGGAGUU CCUGUCUU |
| 3285 | GAAGACAG CUGAUGA X GAA AACUCCAU | AUGGAGUUC CUGUCUUC |
| 3290 | UUCUGGAA CUGAUGA X GAA ACAGGAAC | GUUCCUGUC UUCCAGAA |
| 3292 | CUUUCUGG CUGAUGA X GAA AGACAGGA | UCCUGUCUU CCAGAAAG |
| 3293 | ACUUUCUG CUGAUGA X GAA AAGACAGG | CCUGUCUUC CAGAAAGU |
| 3306 | UCCCGAUG CUGAUGA X GAA AUGCACUU | AAGUGCAUU CAUCGGGA |
| 3307 | GUCCCGAU CUGAUGA X GAA AAUGCACU | AGUGCAUUC AUCGGGAC |
| 3310 | CAGGUCCC CUGAUGA X GAA AUGAAUGC | GCAUUCAUC GGGACCUG |
| 3333 | GAUAAAAG CUGAUGA X GAA AUGUUUCU | AGAAACAUU CUUUUAUC |
| 3334 | AGAUAAAA CUGAUGA X GAA AAUGUUUC | GAAACAUUC UUUUAUCU |
| 3336 | UCAGAUAA CUGAUGA X GAA AGAAUGUU | AACAUUCUU UUAUCUGA |
| 3337 | CUCAGAUA CUGAUGA X GAA AAGAAUGU | ACAUUCUUU UAUCUGAG |
| 3338 | UCUCAGAU CUGAUGA X GAA AAAGAAUG | CAUUCUUUU AUCUGAGA |
| 3339 | UUCUCAGA CUGAUGA X GAA AAAAGAAU | AUUCUUUUA UCUGAGAA |
| 3341 | UGUUCUCA CUGAUGA X GAA AUAAAAGA | UCUUUUAUC UGAGAACA |
| 3363 | AAAUCACA CUGAUGA X GAA AUCUUCAC | GUGAAGAUU UGUGAUUU |
| 3364 | AAAAUCAC CUGAUGA X GAA AAUCUUCA | UGAAGAUUU GUGAUUUU |
| 3370 | AAGGCCAA CUGAUGA X GAA AUCACAAA | UUUGUGAUU UUGGCCUU |
| 3371 | CAAGGCCA CUGAUGA X GAA AAUCACAA | UUGUGAUUU UGGCCUUG |
| 3372 | GCAAGGCC CUGAUGA X GAA AAAUCACA | UGUGAUUUU GGCCUUGC |
| 3378 | UCUCUGGC CUGAUGA X GAA AGGCCAAA | UUUGGCCUU GCCCGGGA |
| 3388 | CUUAUAAA CUGAUGA X GAA AUCCCGGG | CCCGGGAUA UUUAUAAG |
| 3390 | UUCUUAUA CUGAUGA X GAA AUAUCCCG | CGGGAUAUU UAUAAGAA |
| 3391 | GUUCUUAU CUGAUGA X GAA AAUAUCCC | GGGAUAUUU AUAAGAAC |
| 3392 | GGUUCUGA CUGAUGA X GAA AAAUAUCC | GGAUAUUUA UAAGAACC |
| 3394 | GGGGUUCU CUGAUGA X GAA AUAAAUAU | AUAUUUAUA AGAACCCC |
| 3406 | UCUCACAU CUGAUGA X GAA AUCGGGGU | ACCCCGAUU AUGUGAGA |
| 3407 | UUCUCACA CUGAUGA X GAA AAUCGGGG | CCCCGAUUA UGUGAGAA |

TABLE II-continued

Human flt1 VEGF Receptor-Hammerhead Ribozyme and Substrate Sequence

| nt. Position | HH Ribozyme | Substrate |
|---|---|---|
| 3424 | AAGUCGAG CUGAUGA X GAA AUCUCCUU | AAGGAGAUA CUCGACUU |
| 3427 | AGGAAGUC CUGAUGA X GAA AGUAUCUC | GAGAUACUC GACUUCCU |
| 3432 | UUCAGAGG CUGAUGA X GAA AGUCGAGU | ACUCGACUU CCUCUGAA |
| 3433 | UUUCAGAG CUGAUGA X GAA AAGUCGAG | CUCGACUUC CUCUGAAA |
| 3436 | CCAUUUCA CUGAUGA X GAA AGGAAGUC | GACUUCCUC UGAAAUGG |
| 3451 | AGAUUCGG CUGAUGA X GAA AGCCAUUC | GGAUGGCUC CCGAAUCU |
| 3458 | CAAAGAUA CUGAUGA X GAA AUUCGGGA | UCCCGAAUC UAUCUUUG |
| 3460 | GUCAAAGA CUGAUGA X GAA AGAUUCUG | CCGAAUCUA UCUUUGAC |
| 3462 | UUGUCAAA CUGAUGA X GAA AUAGAUUC | GAAUCUAUC UUUGACAA |
| 3464 | UUUUGUCA CUGAUGA X GAA AGAUAGAU | AUCUAUCUU UGACAAAA |
| 3465 | AUUUUGUC CUGAUGA X GAA AAGAUAGA | UCUAUCUUU GACAAAAU |
| 3474 | GUGCUGUA CUGAUGA X GAA AUUUUGUC | GACAAAAUC UACAGCAC |
| 3476 | UGGUGCUG CUGAUGA X GAA AGAUUUUG | CAAAAUCUA CAGCACCA |
| 3500 | CUCCGUAA CUGAUGA X GAA ACCACACG | CGUGUGGUC UUACGGAG |
| 3502 | UACCCGU CUGAUGA X GAA AGACCACA | UGUGGUCUU ACGGAGUA |
| 3503 | AUACCCG CUGAUGA X GAA AAGACCAC | GUGGUCUUA CGGAGUAU |
| 3510 | CACAGCAA CUGAUGA X GAA ACUCCGUA | UACGGAGUA UUGCUGUG |
| 3512 | CCCACAGC CUGAUGA X GAA AUACUCCG | CGGAGUAUU GCUGUGGG |
| 3525 | AAGGAGAA CUGAUGA X GAA AUUUCCCA | UGGGAAAUC UUCUCCUU |
| 3527 | CUAAGGAG CUGAUGA X GAA AGAUUUCC | GGAAAUCUU CUCCUUAG |
| 3528 | CCUAAGGA CUGAUGA X GAA AAGAUUUC | GAAAUCUUC UCCUUAGG |
| 3530 | CAACUAAG CUGAUGA X GAA AGAAGAUU | AAUCUUCUC CUUAGGUG |
| 3533 | ACCCACCU CUGAUGA X GAA AGGAGAAG | CUUCUCCUU AGGUGGGU |
| 3534 | GACCCACC CUGAUGA X GAA AAGGAGAA | UUCUCCUUA GGUGGGUC |
| 3542 | GGUAUGGA CUGAUGA X GAA ACCCACCU | AGGUGGGUC UCCAUACC |
| 3544 | UGGGUAUG CUGAUGA X GAA AGACCCAC | GUGGGUCUC CAUACCCA |
| 3548 | CUCCUGGG CUGAUGA X GAA AUGGAGAC | GUCUCCAUA CCCAGGAG |
| 3558 | UCCAUUUG CUGAUGA X GAA ACUCCUGG | CCAGGAGUA CAAAUGGA |
| 3575 | GACUGCAA CUGAUGA X GAA AGUCCUCA | UGAGGACUU UUGCAGUC |
| 3576 | CGACUGCA CUGAUGA X GAA AAGUCCUC | GAGGACUUU UGCAGUCG |
| 3577 | GCGACUGC CUGAUGA X GAA AAAGUCCU | AGGACUUUU GCAGUCGC |
| 3583 | CCUCAGGC CUGAUGA X GAA ACUGCAAA | UUUGCAGUC GCCUGAGG |
| 3613 | GUACUCAG CUGAUGA X GAA AGCUCUCA | UGAGAGCUC CUGAGUAC |
| 3620 | GAGUAGAG CUGAUGA X GAA ACUCAGGA | UCCUGAGUA CUCUACUC |
| 3623 | CAGGAGUA CUGAUGA X GAA AGUCUCUC | UGAGUACUC UACUCCUG |
| 3625 | UUCAGGAG CUGAUGA X GAA AGAGUACU | AGUACUCUA CUCCUGAA |

TABLE II-continued

Human flt1 VEGF Receptor-Hammerhead Ribozyme and Substrate Sequence

| nt. Position | HH Ribozyme | Substrate |
|---|---|---|
| 3628 | GAUUUCAG CUGAUGA X GAA AGUAGAGU | ACUCUACUC CUGAAAUC |
| 3636 | AUCUGAUA CUGAUGA X GAA AUUUCAGG | CCUGAAAUC UAUCAGAU |
| 3638 | UGAUCUGA CUGAUGA X GAA AGAUUUCA | UGAAAUCUA UCAGAUCA |
| 3640 | CAUGAUCU CUGAUGA X GAA AUAGAUUU | AAAUCUAUC AGAUCAUG |
| 3645 | UCCAGCAU CUGAUGA X GAA AUCUGAUA | UAUCAGAUC AUGCUGGA |
| 3689 | GUUCUGCA CUGAUGA X GAA AUCUUGGC | GCCAAGAUU UGCAGAAC |
| 3690 | AGUUCUGC CUGAUGA X GAA AAUCUUGG | CCAAGAUUU GCAGAACU |
| 3699 | UUUUCCAC CUGAUGA X GAA AGUUCUGC | GCAGAACUU GUGGAAAA |
| 3711 | AAAUCACC CUGAUGA X GAA AGUUUUUC | GAAAAACUA GGUGAUUU |
| 3718 | UUGAAGCA CUGAUGA X GAA AUCACCUA | UAGGUGAUU UGCUUCAA |
| 3719 | CUUGAAGC CUGAUGA X GAA AAUCAGCU | AGGUGAUUU GCUUCAAG |
| 3723 | UUUGCUUG CUGAUGA X GAA AGCAAAUC | GAUUUGCUU CAAGCAAA |
| 3724 | AUUUGCUU CUGAUGA X GAA AAGCAAAU | AUUUGCUUC AAGCAAAU |
| 3735 | UCCUGUUG CUGAUGA X GAA ACAUUUGC | GCAAAUGUA CAACAGGA |
| 3748 | GUAGUCUU CUGAUGA X GAA ACCAUCCU | AGGAUGGUA AAGACUAC |
| 3755 | UUGGGAUG CUGAUGA X GAA AGUCUUUA | UAAAGACUA CAUCCCAA |
| 3759 | UUGAUUGG CUGAUGA X GAA AUGUAGUC | GACUACAUC CCAAUCAA |
| 3765 | AUGCCAUU CUGAUGA X GAA AUUGGGAU | AUCCCAAUC AAUGCCAU |
| 3774 | CCUGUCAG CUGAUGA X GAA AUGGCAUU | AAUGCCAUA CUGACAGG |
| 3787 | AAACCCAC CUGAUGA X GAA AUUUCCUG | CAGGAAAUA GUGGGUUU |
| 3794 | AGUAUGUA CUGAUGA X GAA ACCCACUA | UAGUGGGUU UACAUACU |
| 3795 | GAGUAUGU CUGAUGA X GAA AACCCACU | AGUGGGUUU ACAUACUC |
| 3796 | UCAGUAUG CUGAUGA X GAA AAACCCAC | GUGGGUUUA CAUACUCA |
| 3800 | GAGUUGAG CUGAUGA X GAA AUGUAAAC | GUUUACAUA CUCAACUC |
| 3803 | CAGGAGUU CUGAUGA X GAA AGUAUGUA | UACAUACUC ACCUCCUG |
| 3808 | GAAGGCAG CUGAUGA X GAA AGUUGAGU | ACUCAACUC CUGCCUUC |
| 3815 | CCUCAGAG CUGAUGA X GAA AGGCAGGA | UCCUGCCUU CUCUGAGG |
| 3816 | UCCUCAGA CUGAUGA X GAA AAGGCAGG | CCUGCCUUC UCUGAGGA |
| 3818 | AGUCCUCA CAGAUGA X GAA AGAAGGCA | UCCCUUCUC UGAGGACU |
| 3827 | CCUUGAAG CUGAUGA X GAA AGUCCUCA | AGAGGACUU CUUCAAGG |
| 3828 | UCCUUGAA CUGAUGA X GAA AAGUCCUC | GAGGACUUC UUCAAGGA |
| 3830 | UUUCCUUG CUGAUGA X GAA AGAAGUCC | GGACUUCUU CAAGGAAA |
| 3831 | CUUUCCUU CUGAUGA X GAA AAGAAGUC | GACUUCUUC AAGGAAAG |
| 3841 | AGCUGAAA CUGAUGA X GAA ACUUUCCU | AGGAAAGUA UUUCAGCU |
| 3843 | GGAGCUGA CUGAUGA X GAA AUACUUUC | GAAAGUAUU UCAGCUCC |
| 3844 | CGGAGCUG CUGAUGA X GAA AAUACUUU | AAAGUAUUU CAGCUCCG |
| 3845 | UCGGAGCU CUGAUGA X GAA AAAUACUU | AAGUAUUUC AGCUCCGA |

TABLE II-continued

Human flt1 VEGF Receptor-Hammerhead Ribozyme and Substrate Sequence

| nt. Position | HH Ribozyme | Substrate |
|---|---|---|
| 3850 | AAACUUCG CUGAUGA X GAA AGCUGAAA | UUUCAGCUC CGAAGUUU |
| 3857 | CUGAAUUA CUGAUGA X GAA ACUUCGGA | UCCGAAGUU UAAUUCAG |
| 3858 | CCUGAAUU CUGAUGA X GAA AACUUCGG | CCGAAGUUU AAUUCAGG |
| 3859 | UCCUGAAU CUGAUGA X GAA AAACUUCG | CGAAGUUUA AUUCAGGA |
| 3862 | GCUUCCUG CUGAUGA X GAA AUUAAACU | AGUUUAAUU CAGGAAGC |
| 3863 | AGCUUCCU CUGAUGA X GAA AAUUAAAC | GUUUAAUUC AGGAAGCU |
| 3872 | CAUCAUCA CUGAUGA X GAA AGCUUCCU | AGGAAGCUC UGAUGAUG |
| 3882 | ACAUAUCU CUGAUGA X GAA ACAUCAUC | GAUGAUGUC AGAUAUGU |
| 3887 | CAUUUACA CUGAUGA X GAA AUCUGACA | UGUCAGAUA UGUAAAUG |
| 3891 | AAAGCAUU CUGAUGA X GAA ACAUAUCU | AGAUAUGUA AAUGCUUU |
| 3898 | GAACUUGA CUGAUGA X GAA AGCAUUUA | UAAAUGCUU UCAAGUUC |
| 3899 | UGAACUUG CUGAUGA X GAA AAGCAUUU | AAAUGCUUU CAAGUUCA |
| 3900 | AUGAACUU CUGAUGA X GAA AAAGCAUU | AAUGCUUUC AAGUUCAU |
| 3905 | GGCUCAUG CUGAUGA X GAA ACUUGAAA | UUUCAAGUU CAUGAGCC |
| 3906 | AGGCUCAU CUGAUGA X GAA AACUUGAA | UUCAAGUUC AUGAGCCU |
| 3924 | AAGGUUUU CUGAUGA X GAA AUUCUUUC | GAAAGAAUC AAAACCUU |
| 3932 | GUUCUUCA CUGAUGA X GAA AGGUUUUG | CAAAACCUU UGAAGAAC |
| 3933 | AGUUCUUC CUGAUGA X GAA AAGGUUUU | AAAACCUUU GAAGAACU |
| 3942 | UUCGGUAA CUGAUGA X GAA AGUUCUUC | GAAGAACUU UUACCGAA |
| 3943 | AUUCGGUA CUGAUGA X GAA AAGUUCUU | AAGAACUUU UACGGAAU |
| 3944 | CAUUCGGU CUGAUGA X GAA AAAGUUCU | AGAACUUUU ACUGAAUG |
| 3945 | GCAUUCGG CUGAUGA X GAA AAAAGUUC | GAACUUUUA CCGAAUGC |
| 3959 | CAAACAUG CUGAUGA X GAA AGGUGGCA | UGCCAGCUC CAUGUUUG |
| 3965 | AGUCAUCA CUGAUGA X GAA ACAUGGAG | CUCCAUGUU UGAUGACU |
| 3966 | UAGUCAUC CUGAUGA X GAA AACAUGGA | UCCAUGUUU GAUGACUA |
| 3974 | CGCCCUGG CUGAUGA X GAA AGUCAUCA | UGAUGACUA CCAGGGCG |
| 3994 | GGCCAACA CUGAUGA X GAA AGUGCUGC | GCAGCACUC UGUUGGCC |
| 3998 | GAGAGGGC CUGAUGA X GAA ACAGAGUG | CACUCUGUU GGCCUCUC |
| 4004 | GCAUGGGA CUGAUGA X GAA AGGCCAAC | GUUGGCCUC UCCCAUGC |
| 4006 | CAGCAUGG CUGAUGA X GAA AGAGGCCA | UGGCCUCUC CCAUGCUG |
| 4022 | UCCAGGUG CUGAUGA X GAA AGCGUUCC | GAAGCGCUU CACCUGGA |
| 4023 | GUCCAGGU CUGAUGA X GAA AAGCGCUU | AAGCGCUUC ACCUGGAC |
| 4052 | UCUUGAGC CUGAUGA X GAA AGGCCUUG | CAAGGCCUC GCUCAAGA |
| 4056 | UCAAUCUU CUGAUGA X GAA AGCGAGGC | GCCUCGCUC AAGAUUGA |
| 4062 | CUCAAGUC CUGAUGA X GAA AUCUUGAG | CUCAAGAUU GACUUGAG |
| 4067 | UUACUCUC CUGAUGA X GAA AGUCAAUC | GAUUGACUU GAGAGUAA |

TABLE II-continued

Human flt1 VEGF Receptor-Hammerhead Ribozyme and Substrate Sequence

| nt. Position | HH Ribozyme | Substrate |
|---|---|---|
| 4074 | UUACUGGU CUGAUGA X GAA ACUCUCAA | UUGAGAGUA ACCAGUAA |
| 4081 | CUUACUUU CUGAUGA X GAA ACUGGUUA | UAACCAGUA AAAGUAAG |
| 4087 | CGACUCCU CUGAUGA X GAA ACUUUUAC | GUAAAAGUA AGGAGUCG |
| 4094 | ACAGCCCC CUGAUGA X GAA ACUCCUUA | UAAGGAGUC GGGGCUGU |
| 4103 | UGACAUCA CUGAUGA X GAA ACAGCCCC | GGGGCUGUC UGAUGUCA |
| 4110 | GGCCUGCU CUGAUGA X GAA ACAGCAGA | UCUGAUGUC AGCAGCUC |
| 4123 | AUGGCAGA CUGAUGA X GAA ACUGGGCC | GGGCCAGUU UCUGCCAU |
| 4124 | AAUGGCAG CUGAUGA X GAA AACUGGGC | GCCCAGUUU CUGCCAUU |
| 4125 | GAAUGGCA CUGAUGA X GAA AAACUGGG | CCCAGUUUC UGCCAUUC |
| 4132 | ACAGCUGG CUGAUGA X GAA AUGGCAGA | UCUGCCAUU CCAGCUGU |
| 4133 | CACAGCUG CUGAUGA X GAA AAUGGCAG | CUGCCAUUC CGGCUGUG |
| 4149 | CCUUCGCU CUGAUGA X GAA ACGUGCCC | GGGCACGUC AGCGAAGG |
| 4169 | CGUAGGUG CUGAUGA X GAA ACCUGGGC | GCGCAGGUU CACCUACG |
| 4170 | UCGUAGGU CUGAUGA X GAA AACCUGGG | CGCAGGUUC ACCUACGA |
| 4175 | CGUGGUCG CUGAUGA X GAA AGGUGAAC | GUUCACCUA CGACCACG |
| 4203 | CAGCACGC CUGAUGA X GAA AUUUUCUU | AGGAAAAUC GCGUGCUG |
| 4214 | GGGGCGGG CUGAUGA X GAA AGCAGCAC | GUGCUGCCC CCCGCCCC |
| 4229 | CCGAGUUG CUGAUGA X GAA AGUCUGGG | CCCAGACUA CAACUCGG |
| 4235 | GGACCACC CUGAUGA X GAA AGUUGUAG | CUACAACUC GGUGGUCC |
| 4242 | GAGUACAG CUGAUGA X GAA ACCACCGA | UCGGUGGUC CUGUACUC |
| 4247 | GGGUGGAG CUGAUGA X GAA ACAGGACC | GGUUCUGUA CUCCACCC |
| 4250 | GUGGGGUG CUGAUGA X GAA AGUACAGG | CCUGUACUC CACCCCAC |
| 4263 | AAACUCUA CUGAUGA X GAA AUGGGUGG | CCACCCAUC UAGAGUUU |
| 4265 | UCAAACUC CUGAUGA X GAA AGAUGGGU | ACCCAUCUA GAGUUUGA |
| 4270 | UCGUGUCA CUGAUGA X GAA ACUCUAGA | UCUAGAGUU UGACACGA |
| 4271 | UUCGUGUC CUGAUGA X GAA AACUCUAG | CUAGAGUUU GACACGAA |
| 4284 | CUAGAAAU CUGAUGA X GAA AGGCUUCG | CGAAGCCUU AUUUCUAG |
| 4285 | UCUAGAAA CUGAUGA X GAA AAGGCUUC | GAAGCCUUA UUUCUAGA |
| 4287 | CUUCUAGA CUGAUGA X GAA AUAAGGCU | AGCCUUAUU UCUAGAAG |
| 4288 | GCUUCUAG CUGAUGA X GAA AAUAAGGC | GCCUUAUUU CUAGAAGC |
| 4289 | UGCUUCUA CUGAUGA X GAA AAAUAAGG | CCUUAUUUC UAGAAGCA |
| 4291 | UGUGCUUC CUGAUGA X GAA AGAAAUAA | UUAUUUCUA GAAGCACA |
| 4305 | GGUAUAAA CUGAUGA X GAA ACACAUGU | ACAUGUGUA UUUAUACC |
| 4307 | GGGGUCUA CUGAUGA X GAA AUACACAU | AUGUGUAUU UAUACCCC |
| 4308 | GGGGGUAU CUGAUGA X GAA AAUACACA | UGUGUAUUU AUACCCCC |
| 4309 | UGGGGGUA CUGAUGA X GAA AAAUACAC | GUGUAUUUA UACCCCCA |
| 4311 | CCUGGGGG CUGAUGA X GAA AUAAAUAC | GUAUUUAUA CCCCCAGG |

TABLE II-continued

Human flt1 VEGF Receptor-Hammerhead Ribozyme and Substrate Sequence

| nt. Position | HH Ribozyme | Substrate |
|---|---|---|
| 4325 | GCAAAAGC CUGAUGA X GAA AGUUUCCU | AGGAAACUA GCUUUUGC |
| 4329 | ACUGGCAA CUGAUGA X GAA AGCUAGUU | AACUAGCUU UUGCCAGU |
| 4330 | UACUGGCA CUGAUGA X GAA AAACUAGU | ACUAGCUUU UGCCAGUA |
| 4331 | AUACUGGC CUGAUGA X GAA AAAGCUAG | CUAGCUUUU GCCAGUAU |
| 4338 | AUGCAUAA CUGAUGA X GAA ACUGGCAA | UUGCCAGUA UUAUGCAU |
| 4340 | AUAUGCAU CUGAUGA X GAA AUACUGGC | GCCAGUAUU AUGCAUAU |
| 4341 | UAUAUGCA CUGAUGA X GAA AAUACUCG | CCAGUAUUA UGCAUAUA |
| 4347 | AACUUAUA CUGAUGA X GAA AUGCAUAA | UUAUGCAUA UAUAAGUU |
| 4349 | UAAACUUA CUGAUGA X GAA AUAUGCAU | AUGCAUAUA UAAGUUUA |
| 4351 | UGUAAACU CUGAUGA X GAA AUAUAUGC | GCAUAUAUA AGUUUACA |
| 4355 | AACGUGUA CUGAUGA X GAA ACUUAUAU | AUAUAAGUU UACACCUU |
| 4356 | AAAGGUGU CUGAUGA X GAA AACUUAUA | UAUAAGUUU ACACCUUU |
| 4357 | UAAGGUG CUGAUGA X GAA AAACUUAU | AUAAGUUUA CACCUUUA |
| 4363 | GAAAGAUA CUGAUGA X GAA AGGUGUAA | UUACACCUU UAUCUUUC |
| 4364 | GGAAAGAU CUGAUGA X GAA AAGGUGUA | UACACCUUU AUCUUUCC |
| 4365 | UAGAAAGA CUGAUGA X GAA AAAGGUGU | ACACCUUUA UCUUUCCA |
| 4367 | CAUGGAAA CUGAUGA X GAA AUAAAGGU | ACCUUUAUC UUUCCAUG |
| 4369 | CCCAUGGA CUGAUGA X GAA AGAUAAAG | CUUUAUCUU UCCAUGGG |
| 4370 | UCCCAUGG CUGAUGA X GAA AAGAUAAA | UUUAUCUUU CCAUGCGA |
| 4371 | CUCCCAUG CUGAUGA X GAA AAAGAUAA | UUAUCUUUC CAUGGGAG |
| 4389 | AUCACAAA CUGAUGA X GAA AGCAGCUG | CAGCUGCUU UUUGUGAU |
| 4390 | AAUCACAA CUGAUGA X GAA AAGCAGCU | AGCUGCUUU UUGUGAUU |
| 4391 | AAAUCACA CUGAUGA X GAA AAAGCAGC | GCUGCUUUU UGUGAUUU |
| 4392 | AAAAUCAC CUGAUGA X GAA AAAAGCAG | CUGCUUUUU GUGAUUUU |
| 4398 | AUUAAAAA CUGAUGA X GAA AUCACAAA | UUUGUGAUU UUAAAAAU |
| 4399 | UAUUAAAA CUGAUGA X GAA AAUCACAA | UUGUGAUUU UUUUAAUA |
| 4400 | CUAUUAAA CUGAUGA X GAA AAAUCACA | UGUGAUUUU UUUAAUAG |
| 4401 | ACUAUUAA CUGAUGA X GAA AAAAUCAC | GUGAUUUUU UUAAUAGU |
| 4402 | CACUAUUA CUGAUGA X GAA AAAAACCA | UGAUUUUUU UAAUAGUG |
| 4403 | GCACUAUU CUGAUGA X GAA AAAAAAUC | GAUUUUUUU AAUAGUGC |
| 4404 | AGCACUAU CUGAUGA X GAA AAAAAAAU | AUUUUUUUA AUAGUGCU |
| 4407 | AAAAGCAC CUGAUGA X GAA AUUAAAAA | UUUUUAAUA GUGCUUUU |
| 4413 | AAAAAAAA CUGAUGA X GAA AGCACUAU | AUAGUGCUU UUUUUUUU |
| 4414 | AAAAAAAA CUGAUGA X GAA AAGCACAA | UAGUGCUUU UUUUUUUU |
| 4415 | CAAAAAAA CUGAUGA X GAA AAAGCACU | AGUGCUUUU UUUUUUUG |
| 4416 | UCAAAAAA CUGAUGA X GAA AAAAGCAC | GUGCUUUUU UUUUUUGA |

TABLE II-continued

Human flt1 VEGF Receptor-Hammerhead Ribozyme and Substrate Sequence

| nt. Position | HH Ribozyme | Substrate |
|---|---|---|
| 4417 | GUCAAAAA CUGAUGA X GAA AAAAAGCA | UGCUUUUUU UUUUUGAC |
| 4418 | AGUCAAAA CUGAUGA X GAA AAAAAAGC | GCUUUUUUU UUUUGACU |
| 4419 | UAGUCAAA CUGAUGA X GAA AAAAAAAG | CUUUUUUUU UUUGACUA |
| 4420 | UUAGUCAA CUGAUGA X GAA AAAAAAAA | UUUUUUUUU UUGACUAA |
| 4421 | GUUAGUCA CUGAUGA X GAA AAAAAAAA | UUUUUUUUU UGACUAAC |
| 4422 | UGUUAGUC CUGAUGA X GAA AAAAAAAA | UUUUUUUUU GACUAACA |
| 4427 | AUUCUUGU CUGAUGA X GAA ACUCAAAA | UUUUGACUA ACAAGAAU |
| 4438 | UCUGGAGU CUGAUGA X GAA ACAUUCUU | AAGAAUGUA ACUCCAGA |
| 4442 | UCUAUCUG CUGAUGA X GAA AGUUACAU | AUGUAACUC CAGAUAGA |
| 4448 | UAUUUCUC CUGAUGA X GAA AUCUGGAG | CUCCAGAUA GAGAAAUA |
| 4456 | CUUGUCAC CUGAUGA X GAA AUUUCUCU | AGAGAAAUA GUGACAAG |
| 4476 | UUUAGCAG CUGAUGA X GAA AGUGUUCU | AGAACACUA CUGCUAAA |
| 4482 | UGAGGAUU CUGAUGA X GAA AGCAGUAG | CUACUGCUA AAUCCUCA |
| 4486 | AACAUGAG CUGAUGA X GAA AUUUAGCA | UGCUAAAUC CUCAUGUU |
| 4489 | AGUAACAU CUGAUGA X GAA AGGAUUUA | UAAAUCCUC AUGUUACU |
| 4494 | CACUGAGU CUGAUGA X GAA ACAUGAGG | CCUCAUGUU ACUCAGUG |
| 4495 | ACACUGAG CUGAUGA X GAA AACAUGAG | CUCAUGUUA CUCAGUGU |
| 4498 | CUAACACU CUGAUGA X GAA AGUAACAU | AUGUUACUC AGUGUUAG |
| 4504 | AUUUCUCU CUGAUGA X GAA ACACUGAG | CUCAGUGUU AGAGAAAU |
| 4505 | GAUUUCUC CUGAUGA X GAA AACACUGA | UCAGUGUUA GAGAAAUC |
| 4513 | UUAGGAAG CUGAUGA X GAA AUUUCUCU | AGAGAAAUC CUUCCUAA |
| 4516 | GGUUUAGG CUGAUGA X GAA AGGAUUUC | GAAAUCCUU CCUAAACC |
| 4517 | GGGUUUGG CUGAUGA X GAA AAGGAUUU | AAAUCCUUC CUAAACCC |
| 4520 | AUUGGGUU CUGAUGA X GAA AGGAAGGA | UCCUUCCUA AACCCAAU |
| 4533 | GAGCAGGG CUGAUGA X GAA AGUCAUUG | CAAUGACUU CCCUGCUC |
| 4534 | GGAGCAGG CUGAUGA X GAA AAGUCAUU | AAUGACUUC CCUGCUCC |
| 4541 | GGGGGUUG CUGAUGA X GAA AGCAGGGA | UCCCUGCUC CAACCCCC |
| 4557 | CGUGCCCU CUGAUGA X GAA AGGUGCCG | CCCCACCUC AGGGCACG |
| 4576 | CUCAAUCA CUGAUGA X GAA ACUGGUCC | GGACCAGUU UGAUUGAG |
| 4577 | CCUCAAUC CUGAUGA X GAA AACUGGUC | GACCAGUUU GAUUGAGG |
| 4581 | AGCUCCUC CUGAUGA X GAA AUCAAACU | AGUUUGAUU GAGGAGCU |
| 4598 | CAUUGGGU CUGAUGA X GAA AUCAGUGC | GCACUGAUC ACCCAAUG |
| 4610 | GGGUACGU CUGAUGA X GAA AUGCAUUG | CAAUGCAUC ACGUACCC |
| 4615 | CAGUGGGG CUGAUGA X GAA ACGUGAUG | CAUCACGUA CCCCACUG |
| 4664 | CUGGGGCU CUGAUGA X GAA ACGGGCUU | AAGCCCGUU AGCCCAG |
| 4665 | CCUGGGGC CUGAUGA X GAA AACGGGCU | AGCCCGUUA GCCCCAGG |
| 4678 | CAGCCAGU CUGAUGA X GAA AUCCCCUG | CAGGGGAUC ACUGGCUG |

TABLE II-continued

Human flt1 VEGF Receptor-Hammerhead Ribozyme and Substrate Sequence

| nt. Position | HH Ribozyme | Substrate |
| --- | --- | --- |
| 4700 | ACUCCCGA CUGAUGA X GAA AUGUUGCU | AGCAACAUC UCGGGAGU |
| 4702 | GGACUCCC CUGAUGA X GAA AGAUGUUG | CAACAUCUC GGGAGUCC |
| 4709 | UGCUAGAG CUGAUGA X GAA ACUCCCGA | UCGGGAGUG CUCUAGCA |
| 4712 | GCCUCCCA CUGAUGA X GAA AGGACUCC | GGAGUCCUC UAGCAGGC |
| 4714 | AGGCCUGC CUGAUGA X GAA AGAGGACU | AGUCCUCUA GCAGGCCU |
| 4723 | ACAUGUCU CUGAUGA X GAA AGGCCUGC | GCAGGCCUA AGACAUGU |
| 4802 | GCGUCUCA CUGAUGA X GAA AUUCUUUC | GAAAGAAUU UGAGACGC |
| 4803 | UGCGUCUC CUGAUGA X GAA AAUUCUUU | AAAGAAUUU GAGACGCA |
| 4840 | GCAUUCCU CUGAUGA X GAA AGCCCCGU | ACGGGGCUC AGCAAUGC |
| 4852 | GCCACUGA CUGAUGA X GAA AUGGCAUU | AAUGCCAUU UCAGUGGC |
| 4853 | AGCCACUG CUGAUGA X GAA AAUGGCAU | AUGCCAUUU CAGUGGCU |
| 4854 | AAGCCACU CUGAUGA X GAA AAAUGGCA | UGCCAUUUC AGUGGCUU |
| 4862 | GAGCUGGG CUGAUGA X GAA AGCCACUG | CAGUGGCUU CCCAGCUC |
| 4863 | AGAGCUGG CUGAUGA X GAA AAGCCACU | AGUGGCUUC CCAGCUCU |
| 4870 | AAGGGUCA CUGAUGA X GAA AGCUGGGA | UCCCAGCUC UGACCCUU |
| 4878 | AAAUGUAG CUGAUGA X GAA AGGGUCAG | CUGACCCUU CUACAUUU |
| 4879 | CAAAUGUA CUGAUGA X GAA AAGGGUCA | UGACCCUUC UACAUUUG |
| 4881 | CUCAAAUG CUGAUGA X GAA AGAAGGGU | ACCCUUCUA CAUUUGAG |
| 4885 | GGCCCUCA CUGAUGA X GAA AUGUAGAA | UUCUACAUU UGAGGGCC |
| 4886 | GGGCCCUC CUGAUGA X GAA AAUGUAGA | UCUACAUUU GAGGGCCC |
| 4929 | AUCCAGAA CUGAUGA X GAA AUGUCCCC | GGGGACAUU UUCUGGAU |
| 4930 | AAUCCAGA CUGAUGA X GAA AAUGUCCC | GGGACAUUU UCUGGAUU |
| 4931 | GAAUCCAG CUGAUGA X GAA AAAUGUCC | GGACAUUUU CUGGAUUC |
| 4932 | AGAAUCCA CUGAUGA X GAA AAAAUGUC | GACAUUUUC UGGAUUCU |
| 4938 | CCUCCCAG CUGAUGA X GAA AUCCAGAA | UUCUGGAUU CUGGGAGG |
| 4939 | GCCUCCCA CUGAUGA X GAA AAUCCAGA | UCUGGAUUC UGGGAGGC |
| 4963 | AAAAAAGA CUGAUGA X GAA AUUUGUCC | GGACAAAUA UCUUUUUU |
| 4965 | CCAAAAAA CUGAUGA X GAA AUAUUUGU | ACAAAUAUC UUUUUUGG |
| 4967 | UUCCAAAA CUGAUGA X GAA AGAUAUUU | AAAUAUCUU UUUUGGAA |
| 4968 | GUUCCAAA CUGAUGA X GAA AAGAUAUU | AAUAUCUUU UUUGGAAC |
| 4969 | AGUUCCAA CUGAUGA X GAA AAAGAUAU | AUUUCUUUU UUGGAACU |
| 4970 | UAGUUCCA CUGAUGA X GAA AAAAGAUA | UAUCUUUUU UGGAACUA |
| 4971 | UUAGUUCC CUGAUGA X GAA AAAAAGAU | AUCUUUUUU GGAACGAA |
| 4978 | AUUUGCUU CUGAUGA X GAA AGUUCCAA | UUGGAACUA AAGCAAAU |
| 4987 | AGGUCUAA CUGAUGA X GAA AUUUGUU | AAGCAAAUU UUAGACCU |
| 4988 | AAGGUCUA CUGAUGA X GAA AAUUUGCU | AGCAAAUUU UAGACCUU |

TABLE II-continued

Human flt1 VEGF Receptor-Hammerhead Ribozyme and Substrate Sequence

| nt. Position | HH Ribozyme | Substrate |
|---|---|---|
| 4989 | AAAGGUCU CUGAUGA X GAA AAAUUUGC | GCAAAUUUU AGACCUUU |
| 4990 | UAAAGGUC CUGAUGA X GAA AAAAUUUG | CAAAUUUUA GACCUUUA |
| 4996 | CAUAGGUA CUGAUGA X GAA AGGUCUAA | UUAGACCUU UACCUAUG |
| 4997 | CCAUAGGU CUGAUGA X GAA AAGGUCUA | UAGACCUUU ACCUAUGG |
| 4998 | UCCAUAGG CUGAUGA X GAA AAAGGUCU | AGACCUUUA CCUAUGGA |
| 5002 | CACUUCCA CUGAUGA X GAA AGGUAAAG | CUUUACCUA UGGAAGUG |
| 5013 | GGACAUAG CUGAUGA X GAA ACCACUUC | GAAGUGGUU CUAUGUCC |
| 5014 | UGGACAUA CUGAUGA X GAA AACCACUU | AAGUGGUUC UAUGUCCA |
| 5016 | AAUGGACA CUGAUGA X GAA AGAACCAC | GUGGUUCUA UGUCCAUU |
| 5020 | UGAGAAUG CUGAUGA X GAA ACAUAGAA | UUCUAUGUC CAUUCUCA |
| 5024 | GGAAUGAG CUGAUGA X GAA AUGGACAU | AUGUCCAUU CUCAUUCG |
| 5025 | ACGAAUGA CUGAUGA X GAA AAUGGACA | UGUCCAUUC UCAUUCGU |
| 5027 | CCACGAAU CUGAUGA X GAA AGAAUCGA | UCCAUUCUC AUUCGUGG |
| 5030 | AUGCCACG CUGAUGA X GAA AUGAGAAU | AUUCUCAUU CGUGGCAU |
| 5031 | CAUGCCAC CUGAUGA X GAA AUGAGAA | UUCUCAUUC GUGGCAUG |
| 5041 | CAAAUCAA CUGAUGA X GAA ACAUGCCA | UGGCAUGUU UUGAUUUG |
| 5042 | ACAAAUCA CUGAUGA X GAA AACAUGCC | GGCAUGUUU UGAUUUCU |
| 5043 | UACAAAUC CUGAUGA X GAA AAACAUGC | GCAUGUUUU GAUUUGUA |
| 5047 | GUUCUACA CUGAUGA X GAA AUCAAAAC | GUUUUGAUU UGUAGCAC |
| 5048 | AGUGCUAC CUGAUGA X GAA AAUCAAAA | UUUUGAUUU GUAGCACU |
| 5051 | CUCAGUGC CUGAUGA X GAA ACAAAUCA | UGAUUUGUA GCACUGAG |
| 5069 | UCAGAGUU CUGAUGA X GAA AGUGCCAC | GUGGCACUC AACUCUGA |
| 5074 | UGGGCUCA CUGAUGA X GAA AGUUGAGU | ACUCAACUC UGAGCCCA |
| 5084 | GCCAAAAG CUGAUGA X GAA AUGGGCUC | GAGCCCAUA CUUUUGGC |
| 5087 | GGAGCCAA CUGAUGA X GAA AGUAUGGG | CCCAUACUU UUGGCUCC |
| 5088 | AGGAGCCA CUGAUGA X GAA AAGUAUGG | CCAUACUUU UGGCUCCU |
| 5089 | GAGGAGCC CUGAUGA X GAA AAAGUAUG | CAUACUUUU GGCUCCUC |
| 5094 | UACUAGAG CUGAUGA X GAA AGCCAAAA | UUUUGGCUC CUCUAGUA |
| 5097 | UCUUACUA CUGAUGA X GAA AGGAGCCA | UGGCUCCUC UAGUAAGA |
| 5099 | CAUCUUAC CUGAUGA X GAA AGAGGAGC | GCUCCUCUA GUAAGAUG |
| 5102 | GUGCAUCU CUGAUGA X GAA ACUAGAGG | CCUCUAGUA AGAUGCAC |
| 5119 | CUCUGGCU CUGAUGA X GAA AGUUUUCA | UGAAAACUU AGCCAGAG |
| 5120 | ACUCUGGC CUGAUGA X GAA AAGUUUUC | GAAAACUUA GCCAGAGU |
| 5129 | GACAACCU CUGAUGA X GAA ACUCUGGC | GCCAGAGUU AGGUUGUC |
| 5130 | AGACAACC CUGAUGA X GAA AACUCUGG | CCAGAGUUA GGUUGUCU |
| 5134 | CUGGAGAC CUGAUGA X GAA ACCUAACU | AGUUAGGUU GUCUCCAG |
| 5137 | GGCCUGGA CUGAUGA X GAA ACAACCUA | UAGGUUGUC UCCAGGCC |

TABLE II-continued

Human flt1 VEGF Receptor-Hammerhead Ribozyme and Substrate Sequence

| nt. Position | HH Ribozyme | Substrate |
|---|---|---|
| 5139 | AUGGCCUG CUGAUGA X GAA AGACAACC | GGUUGUCUC CAGGCCAU |
| 5156 | UUCAGUGU CUGAUGA X GAA AUGCCAUC | GAUGGCCUU ACACUGAA |
| 5157 | UUUCAGUG CUGAUGA X GAA AAGGCCAU | AUGGCUUUA CACUGAAA |
| 5170 | UAGAAUGU CUGAUGA X GAA ACAUUUUC | GAAAAUGUC ACAUUCUA |
| 5175 | CAAAAUAG CUGAUGA X GAA AUGUGACA | UGUCACAUU CUAUUUUG |
| 5176 | CCAAAAUA CUGAUGA X GAA AAUGUGAC | GCCACAUUC UAUUUUGG |
| 5178 | ACCCAAAA CUGAUGA X GAA AGAAUGUG | CACAUUCUA UUUUGGGU |
| 5180 | AUACCCAA CUGAUGA X GAA AUAGAAUG | CAUUCAUUU UUGGGUAU |
| 5181 | AAUACCCA CUGAUGA X GAA AAUAGAAU | AUUCUAUUU UGGGUAUU |
| 5182 | UAAUACCC CUGAUGA X GAA AAAUAGAA | UUCUAUUUU GGGUAUUA |
| 5187 | UAUAUUAA CUGAUGA X GAA ACCCAAAA | UUUUGGGUA UUAAUAUA |
| 5189 | UAUAUAUU CUGAUGA X GAA AUACCCAA | UUGGGUAUU AAUAUAUA |
| 5190 | CUAUAUAU CUGAUGA X GAA AAUACCCA | UGGGUAUUA AUAUAUAG |
| 5193 | GGACUAUA CUGAUGA X GAA AUUAAUAC | GUAUUAAUA UAUAGUCC |
| 5195 | CUGGACUA CUGAUGA X GAA AUAUUAAU | AUUAAUAUA UAGUCCAG |
| 5197 | GUCUGGAC CUGAUGA X GAA AUAUAUUA | UAAUAUAUA GUCCAGAC |
| 5200 | AGUCUCUG CUGAUGA X GAA ACUAUAUA | UAUAUAGUC CAGACACU |
| 5209 | AUUGAGUU CUGAUGA X GAA AGUGUCUG | CAGACACUU AACUCAAU |
| 5210 | AAUUGAGU CUGAUGA X GAA AAGAGUCU | AGACACUUA ACUCAAUU |
| 5214 | AAGAAAUU CUGAUGA X GAA AGUUAAGU | ACUUAACUC AAUUUCUU |
| 5218 | UACCAAGA CUGAUGA X GAA AUUAAGUU | AACUCAAUU UCUUGGUA |
| 5219 | AUACCAAG CUGAUGA X GAA AAUUGAGU | ACUCAAUUU CUUGGUAU |
| 5220 | AAUACCAA CUGAUGA X GAA AAAAUAAG | CUCAAUUUC UUGGUAUU |
| 5222 | AUAAUACC CUGAUGA X GAA AGAAAUUG | CAAUUUCUU GGUAUUAU |
| 5226 | CAGAAUAA CUGAUGA X GAA ACCAAGAA | UUCUUGGUA UUAUUCUG |
| 5228 | AACAGAAU CUGAUGA X GAA AUACCAAG | CUUGGUAUU AUUCUGUU |
| 5229 | AAACAGAA CUGAUGA X GAA AAUACCAA | UUGGUAUUA UUCUGUUU |
| 5231 | CAAACAG CUGAUGA X GAA AUAAUACC | GGUAUUAUU CUGUUUUG |
| 5232 | GCAAAACA CUGAUGA X GAA AAUAAUAC | GUAUUAUUC UGUUUUGC |
| 5236 | CUGUGCAA CUGAUGA X GAA ACAGAAUA | UAUUCUGUU UUGCACAG |
| 5237 | ACUGUGCA CUGAUGA X GAA AACAGAAU | AUUCUGUUU UGCACAGU |
| 5238 | AACUGUGC CUGAUGA X GAA AAACAGAA | UUCUGUUUU UCACAGUU |
| 5246 | UCACAACU CUGAUGA X GAA ACUGUGCA | UGCACAGUU AGUUGUGA |
| 5247 | UUCACAAC CUGAUGA X GAA AACUGUGC | GCACGUUCA GUUGUGAA |
| 5250 | UCUUUCAC CUGAUGA X GAA ACUUACUG | CAGUUAGUU GUGAAAGA |
| 5284 | CUCCUCAG CUGAUGA X GAA ACUGCAUU | AAUGCAGUC CUGAGGAG |

TABLE II-continued

Human flt1 VEGF Receptor-Hammerhead Ribozyme and Substrate Sequence

| nt. Position | HH Ribozyme | Substrate |
|---|---|---|
| 5296 | AUGGAGAA CUGAUGA X GAA ACUCUCCU | AGGAGAGUU UUCUCCAU |
| 5297 | UAUGGAGA CUGAUGA X GAA AACUCUCC | GGAGAGUUU UCUCCUUA |
| 5298 | AUAUGGAG CUGAUGA X GAA AAACUCUC | GAGAGUUUU CUCCAUAU |
| 5299 | GAUAUGGA CUGAUGA X GAA AAAACUCU | AGAGUUUUC UCCAUAUC |
| 5301 | UUGAUAUG CUGAUGA X GAA AGAAAACU | AGUUUCUC CAUAUCAA |
| 5305 | CGUUUUGA CUGAUGA X GAA AUGGAGAA | UUCUCCACA UCAAAACG |
| 5307 | CUCGUUUU CUGAUGA X GAA AUAUUGAG | CUCCAUAUC AAAACGAG |
| 5336 | ACCUUAUU CUGAUGA X GAA ACCUUUUU | AAAAAGGUC AAUAAGGU |
| 5340 | CUUGACCU CUGAUGA X GAA AUUGACCU | AGGUCAAUA AGGUCAAG |
| 5345 | CUUCCCUU CUGAUGA X GAA ACCUUAUU | AAUAAGGUC AAGGGAAG |
| 5361 | GGUAUAGA CUGAUGA X GAA ACGGGUC | GACCCCGUC UCUAUACC |
| 5363 | UUGGUAUA CUGAUGA X GAA AGACGGGG | CCCCGUCUC UAUACCAA |
| 5365 | GGUUGGUA CUGAUGA X GAA AGAGACGG | CCGUCUCCA UACCAACC |
| 5367 | UUGGUUGG CUGAUGA X GAA AUAGAGAC | GUCUCUAUA CCAACCAA |
| 5382 | UGUUGGUG CUGAUGA X GAA AUUGGUUU | AAACCAAUU CACCAACA |
| 5383 | GUGUUGGU CUGAUGA X GAA AAUUGGUU | AACCAAUUC ACCAACAC |
| 5395 | UGGGUCCC CUGAUGA X GAA ACUGUGUU | AACACAGUU GGGACCCA |
| 5417 | ACGUGACU CUGAUGA X GAA ACUUCCUG | CAGGAAGUC AGUCACGU |
| 5421 | GGAAACGU CUGAUGA X GAA ACUGACUU | AAGUCAGUC ACGUUUCC |
| 5426 | GAAAAGGA CUGAUGA X GAA ACGUGACU | AGUCACGUU UCCUUUUC |
| 5427 | UGAAAAGG CUGAUGA X GAA AACGUGAC | GUCACGUUU CCUUUUCA |
| 5428 | AGGAAAAG CUGAUGA X GAA AAACGUGA | UCACGUUUC CUUUUCAU |
| 5431 | UAAUGAA CUGAUGA X GAA AGGAAACG | CGUUUCCUU UUCAUUUA |
| 5432 | UUAAAUGA CUGAUGA X GAA AAGGAAAC | GUUUCCUUU UCAUUUAA |
| 5433 | AUUAAAUG CUGAUGA X GAA AAAGGAAA | UUUCCUUUU CAUUUAAU |
| 5434 | CAUUAAAU CUGAUGA X GAA AAAAGGAA | UUCCUUUUC AUUUAUUG |
| 5437 | CCCCAUUA CUGAUGA X GAA AUGAAAAG | CUUUUCAUU UAAUGGGG |
| 5438 | UCCCCAUU CUGAUGA X GAA AAUGAAAA | UUUUCAUUU AAUGGGGA |
| 5439 | AUCCCCAU CUGAUGA X GAA AAAUGAAA | UUUCAUUUA AUGGGGAU |
| 5448 | GAUAGUGG CUGAUGA X GAA AUCCCCAU | AUGGGGAUU CCACUAUC |
| 5449 | AGAUAGUG CUGAUGA X GAA AAUCCCCA | UGGGGAUUC CACUAUCU |
| 5454 | GUGUGAGA CUGAUGA X GAA AGUGGAAU | AUUCCACUA UCUCACAC |
| 5456 | UAGUGUGA CUGAUGA X GAA AUAGUGGA | UCCACUAUC UCACACUA |
| 5458 | AUUAGUGU CUGAUGA X GAA AGAUAGUG | CACUAUCUC ACACUAAU |
| 5464 | UUUCAGAU CUGAUGA X GAA AGUGUGAG | CUCACACUA AUCUGAAA |
| 5467 | UCCUUUCA CUGAUGA X GAA AUUAGUGU | ACACUAAUC UAAAAGGA |
| 5489 | CGCCAGCU CUGAUGA X GAA AUGCUCUU | AAGAGCAUU AGCUGGCG |

TABLE II-continued

Human flt1 VEGF Receptor-Hammerhead Ribozyme and Substrate Sequence

| nt. Position | HH Ribozyme | Substrate |
|---|---|---|
| 5490 | GCGCCAGC CUGAUGA X GAA AAUGCUCU | AGAGCAUUA GCUGGCGC |
| 5501 | GUCCUGAA CUGAUGA X GAA AUGCGCCA | UGGCGCAUA UUAACCAC |
| 5503 | AAGUGCUU CUGAUGA X GAA AUAUGCGC | GCGCAUAUU AAGCACUU |
| 5504 | AAAGUGCU CUGAUGA X GAA AAUAUGCG | CGCAUAUUA AGCACUUU |
| 5511 | GGAGCUGA CUGAUGA X GAA AGUGCUUA | UAAGCACUU UAAGCUCC |
| 5512 | AGGAGCUU CUGAUGA X GAA AAGUGCUU | AAGGACUUU AAGCUCCU |
| 5513 | AAGGAGCU CUGAUGA X GAA AAAGUGCU | AGCACUUUA AGCUCCUU |
| 5518 | UAGUCAAG CUGAUGA X GAA AGCUUAAA | UUUAAGCUC CUUGAGUA |
| 5521 | UUUUACUC CUGAUGA X GAA AGGAGCUU | AAGCUCCUU GAGUAAAA |
| 5526 | CACCUUUU CUGAUGA X GAA ACUCAAGG | CCUUGAGUA AAAAGGUG |
| 5537 | AAAUUACA CUGAUGA X GAA ACCAGCUU | AAGGUGGUA UGUAAUUU |
| 5541 | GCACAAAU CUGAUGA X GAA AGAAACCA | UGGUAUGUA AUUUAUGC |
| 5544 | CUUGCACA CUGAUGA X GAA AUUACAUA | UAUGUAAUU UAUGCAAG |
| 5545 | CCUUGCAU CUGAUGA X GAA AAUUACAU | AUGUAAUUU AUGCAAGG |
| 5546 | ACCUUGCA CUGAUGA X GAA AAAUUACA | UGUAAUUUA UGCAAGGU |
| 5555 | UGGAGAAA CUGAUGA X GAA ACCUUGCA | UGCAAGGUA UUUCUCCA |
| 5557 | ACUGGAGA CUGAUGA X GAA AUACCUUG | CAAGGUAUU UCUCCAGU |
| 5558 | AACUGGAG CUGAUGA X GAA AAUACCUU | AAGGAAUUU CUCCAGUU |
| 5559 | CAACUGGA CUGAUGA X GAA AAAUACCU | AGGUAUUUC UCCAGUUG |
| 5561 | CCCAACUG CUGAUGA X GAA AGAAAUAC | GUAUUUCUC CAGUUGGG |
| 5566 | UGAGUCCC CUGAUGA X GAA ACUGGAGA | UCUCCAGUU GGGACUCA |
| 5573 | AAUAUCCU CUGAUGA X GAA AGUCCCAA | UUGGGACUC AGGAUAUU |
| 5579 | UUAACUAA CUGAUGA X GAA AUCCUGAG | CUCAGGACA UUAGUUAA |
| 5581 | CAUUAACU CUGAUGA X GAA AUAUCCUG | CAGGAUAUU AGUUAAUG |
| 5582 | UCAUUAAC CUGAUGA X GAA AAUAUCCU | AGGAUAUUA GUUAAUGA |
| 5585 | GGCUCAUU CUGAUGA X GAA ACUAAUAU | AUAUUAGUU AAUGAGCC |
| 5586 | UGGCUCAU CUGAUGA X GAA AACUAAUA | UAUUAGUUA AUGAGCCA |
| 5596 | CUUCUAGU CUGAUGA X GAA AUGGCUCA | UGAGCCAUC ACCAGAAG |
| 5600 | UUUUCUUC CUGAUGA X GAA AGUGAUGG | CCAUCACUA GAAGAAAA |
| 5615 | CAGUUGAA CUGAUGA X GAA AUGGGCUU | AAGCCCAUU UUCAACUG |
| 5616 | GCAGUUGA CUGAUGA X GAA AAUGGGCU | AGCCCAUUU UCAACUGC |
| 5617 | AGCAGUUG CUGAUGA X GAA AAAUGGGC | GCCCAUUUU CAACUCCU |
| 5618 | AAGCAGUU CUGAUGA X GAA AAAAUCGG | CCCAUUUUC AACUGCUU |
| 5626 | AAGUUUCA CUGAUGA X GAA AGCACUUG | CAACUGCUU UGAAACUU |
| 5627 | CAAGUUUC CUGAUGA X GAA AAGCAGUU | AACUGCUUU GAAACUUG |
| 5634 | CCCCAGGC CUGAUGA X GAA AGUUUCAA | UUGAAACUU GCCUGGGG |

TABLE II-continued

Human flt1 VEGF Receptor-Hammerhead Ribozyme and Substrate Sequence

| nt. Position | HH Ribozyme | Substrate |
|---|---|---|
| 5644 | CAUGCUCA CUGAUGA X GAA ACCCCACG | CCUGGGUC UGAGCAUG |
| 5661 | UGUCUCCC CUGAUGA X GAA AUUCCCAU | AUGGGAAUA GGGAGACA |
| 5674 | CCCUUUCC CUGAUGA X GAA ACCCUGUC | GACAGGGUA GGAAACGG |
| 5688 | CUGAAGAG CUGAUGA X GAA AGGCGCCC | GGGCGCCUA CUCUUCAG |
| 5691 | ACCCUGAA CUGAUGA X GAA AGUAGGCG | CCCCUACUC UUCAGGGU |
| 5693 | AGACCCUG CUGAUGA X GAA AGAGUAGG | CCUACUCUU CAGGGUCU |
| 5694 | UAGACCCU CUGAUGA X GAA AAGAGUAG | CUACUCUUC AGGGUCUA |
| 5700 | GAUCUUUA CUGAUGA X GAA ACCCUGAA | UUCAGGGUC UAAAGAUC |
| 5702 | UUGAUCUU CUGAUGA X GAA AGACCCUG | CAGGGUCAA AAGAUCAA |
| 5708 | GCCCACUU CUGAUGA X GAA AUCUUUAG | CUAAAGAUC AAGUGGGC |
| 5719 | AGCGAUCC CUGAUGA X GAA AGGCCCAC | GUGGGCCUU GGAUCGCU |
| 5724 | AGCUUAGC CUGAUGA X GAA AUCCAAGG | CCUUGGAUC GCUAAGCU |
| 5728 | AGCCAGCU CUGAUGA X GAA ACCGAUCC | GGAUCGCUA AGCUGGCU |
| 5737 | AUCAAACA CUGAUGA X GAA AGCCAGCU | AGCUGGCUC UGUUUGAU |
| 5741 | UAGCAUCA CUGAUGA X GAA ACGAAGCC | GGCUCUGUU UGAUGCUA |
| 5742 | AUAGCAUC CUGAUGA X GAA AACAGAGC | CCUCUGUUU GAUGCUAU |
| 5749 | UGCAUAAA CUGAUGA X GAA AGCAUCAA | UUGAUGCUA UUUAUGCA |
| 5751 | CUUGCAUA CUGAUGA X GAA AUAGCAUC | GAUGCUAUU UAUGCAAG |
| 5752 | ACUUGCAU CUGAUGA X GAA AAUAGCAU | AUGCUAUUU AUGCAAGU |
| 5753 | AACUUGCA CUGAUGA X GAA AAAUAGCA | UGCUAUUUA UGCAAGUU |
| 5761 | UAGACCCU CUGAUGA X GAA ACUUGCAU | AUGCAAGUU AGGGUCCA |
| 5762 | AUAGACCC CUGAUGA X GAA AACAAGCA | UGCAAGUUA GGGUCUAU |
| 5767 | AAUACAAA CUGAUGA X GAA ACCCUAAC | GUUAGGGUC UAUGUAUU |
| 5769 | UAAAUACA CUGAUGA X GAA AGACCCUA | UAGGGUCUA UGUAUUUA |
| 5773 | AUCCUAAA CUGAUGA X GAA ACAUAGAC | GUCUAUGUA UUUAGGAU |
| 5775 | GCAUCCUA CUGAUGA X GAA AUACAUAG | CUAUGUAUU UAGGAUGC |
| 5776 | CGCAUCCU CUGAUGA X GAA AAUACAUA | UAUGUAUUU AGGAUGCG |
| 5777 | GCGCAUCC CUGAUGA X GAA AAAUACAU | AUGUAUUUA GGAUGCGC |
| 5788 | CUGAAGAG CUGAUGA X GAA AGGCGCAU | AUGCGCCUA CUCUUCAG |
| 5791 | ACCCUGAA CUGAUGA X GAA AGUACGGG | CGCCUACUC UUCAGGGU |
| 5793 | AGACCCUG CUGAUGA X GAA AGAGUAGG | CCUACUCUU CAGGGUCU |
| 5794 | UAGACCCU CUGAUGA X GAA AACAGUAG | CUACUCUUC AGGCUCCA |
| 5800 | GAUCUUUA CUGAUGA X GAA ACCCUGAA | UUCAGGGUC UAAAGAUC |
| 5802 | UUGAUCUU CUGAUGA X GAA AGACCCUG | CAGGGUCUA AAGAUCAA |
| 5808 | GCCCACUU CUGAUGA X GAA AUCUUUAG | CUAAAGAUC AAGUGGGC |
| 5819 | AGCGAUCC CUGAUGA X GAA AGGCCCAC | GUGGGCCUU GGAUCGCU |
| 5824 | AGCUUAGC CUGAUGA X GAA AUCCAAGG | CCUUGGAUC GCUAAGCU |

TABLE II-continued

Human flt1 VEGF Receptor-Hammerhead Ribozyme and Substrate Sequence

| nt. Position | HH Ribozyme | Substrate |
|---|---|---|
| 5828 | AGCCAGCU CUGAUGA X GAA AGCGAUCC | GGAUCGCUA AGCUGGCU |
| 5837 | AUCAAACA CUGAUGA X GAA AGCCAGCU | AGCUGGCUC UGUUUGAU |
| 5841 | UAGCAUCA CUGAUGA X GAA ACAGAGCC | GGCUCUGUU UGAUGCUA |
| 5842 | AUAGCAUC CUGAUGA X GAA AACAGACC | GCUCUGUUU GAUGCUAU |
| 5849 | UGCAUAAA CUGAUGA X GAA AGCAUCAA | UUGAUGCUA UUUAUGCA |
| 5851 | CUUGCAUA CUGAUGA X GAA AUAGCAUC | GAUGCUAUU UAUGCAAG |
| 5852 | ACUUGCAU CUGAUGA X GAA AAUAGCAU | AUGCUAUUU AUGCAAGU |
| 5853 | AACUUGCA CUGAUGA X GAA AAAUAGCA | UUGCAUUUA UGCAAGUU |
| 5861 | UAGACCCU CUGAUGA X GAA ACUUUCAU | AUGCAAGUU AGGGUCUA |
| 5862 | AUAGACCC CUGAUGA X GAA AACUUGCA | UGCAAGUUA GGGUCUAU |
| 5867 | AAUACAUA CUGAUGA X GAA ACCCUAAC | GUUAGGGUC UAUGUAUU |
| 5869 | UAAAUACA CUGAUGA X GAA AGACCCUA | UAGGGUCUA UGUAUUUA |
| 5873 | AUCCUAAA CUGAUGA X GAA ACAUAGAC | GUCUAUGUA UUUAGGAU |
| 5875 | ACAUCCUA CUGAUGA X GAA AUACAUAG | CUAUGUAUU UAGGAUGU |
| 5876 | GACAUCCU CUGAUGA X GAA AAUACAUA | UAUGUAUUU AGGAUGUC |
| 5877 | AGACAUCC CUGAUGA X GAA AAAUACAU | AUGUAUUUA GGAUGUCU |
| 5884 | AAGGUGCA CUGAUGA X GAA ACAUCCUA | UAGGAUGUC UGCACCUU |
| 5892 | GGCUGCAG CUGAUGA X GAA AGGUGCAG | CUGCACCUU CUGCAGCC |
| 5893 | UGGCUGCA CUGAUGA X GAA AAGGUGCA | UGCACCUUC UGCAGCCA |
| 5904 | CAGCUUCU CUGAUGA X GAA ACUGGCUG | CAGCCAGUC AGAAGCUG |
| 5930 | CAAGCAGC CUGAUGA X GAA AUCCACUG | CAGUGGAUU GCUGCUUC |
| 5937 | UCCCCAAG CUGAUGA X GAA AGCAGCAA | UUGCUGCUU CUUUGGGA |
| 5938 | CUCCCCAA CUGAUGA X GAA AAGCAGCA | UGCUGCUUC UUGGGGAG |
| 5940 | UUCUCCCC CUGAUGA X GAA AGAAGCAG | CUGCUUCUU GGGGAGAA |
| 5953 | AGGAAGCA CUGAUGA X GAA ACUCUUCU | AGAAGAGUA UGCUUCCU |
| 5958 | AUAAAAGG CUGAUGA X GAA AGCAAACU | AGGAUCCUU CCUUUUAU |
| 5959 | GAUAAAAG CUGAUGA X GAA AAGCAUAC | GUAUGCUUC AUUUUAUC |
| 5962 | AUGGAUAA CUGAUGA X GAA AGGAAGCA | UGCUUCCUU UUAUCCAU |
| 5963 | CAUGGAUA CUGAUGA X GAA AAGGAAGC | GCUUCCUUU UAUCCAUG |
| 5964 | ACAUGGAU CUGAUGA X GAA AAAGGAAG | CUUCCUUUU AUCCAUGU |
| 5965 | UACAUGGA CUGAUGA X GAA AAAAGGAA | UUCCUUUUA UCCAUGUA |
| 5967 | AUUACAUG CUGAUGA X GAA AUAAAAGG | CCUUUUAUC CAUGUAAU |
| 5973 | AGUUSSSU CUGAUGA X GAA ACAUGGAU | AUCCAUGUA AUUUAACU |
| 5976 | UACAGUUA CUGAUGA X GAA AUUACAUG | CAUGUAAUU UUACUGUA |
| 5977 | CUACACUU CUGAUGA X GAA AAUUACAU | AUGUAAUUU AACUGUAG |
| 5978 | UCUACAGU CUGAUGA X GAA AAAUUACA | UGUAAUUUA ACUGUAGA |

TABLE II-continued

Human flt1 VEGF Receptor-Hammerhead Ribozyme and Substrate Sequence

| nt. Position | HH Ribozyme | Substrate |
|---|---|---|
| 5984 | UCAGGUUC CUGAUGA X GAA ACACUUAA | UUAACUGUA GAACCUGA |
| 5996 | GUUACUUA CUGAUGA X GAA ACCUCAGG | CCUCAGCUC UAAGUAAC |
| 5998 | CGGUUACU CUGAUGA X GAA AGAGCUCA | UCAGCUCUA AGUAACCG |
| 6002 | UCUUCGGU CUGAUGA X GAA ACUUAGAG | CUCUAAGUA ACCGAAGA |
| 6015 | CAGAGGCA CUGAUGA X GAA ACAUUCUU | AAGAAUGUA UGCCUCUG |
| 6021 | UAAGAACA CUGAUGA X GAA AGGCAUAC | GUAUGCCUC UGUUCUUA |
| 6025 | CACAUAAG CUGAUGA X GAA ACAGAGGC | GCCUCUGUU CUUAUGUG |
| 6026 | GCACAUCA CUGAUGA X GAA AACAGAGG | CCUCUGUUC UUAUUUGC |
| 6028 | UGGCACAU CUGAUGA X GAA AGAACAGA | UCUGUUCUU AUGUGCCA |
| 6029 | GUGCCACA CUGAUGA X GAA AAGAACAG | CUGUUCUUA UGUGCCAC |
| 6040 | UAAACAAG CUGAUGA X GAA AUGUGGCA | UGCCACAUC CUUGUUUA |
| 6043 | CUUUAAAC CUGAUGA X GAA AGGAUGUG | CACAUCCUU GUUUAAAG |
| 6046 | AGCCUUCA CUGAUGA X GAA ACAAGGAU | AUCCUUGUU UAAGGCU |
| 6047 | GAGCCUUU CUGAUGA X GAA AACAAGGA | UCCUUGUUU AAAGGCUC |
| 6048 | AGAGCCUU CUGAUGA X GAA AAACAAGG | CCUUGUUUA AAGGCUCU |
| 6055 | CAUACAGA CUGAUGA X GAA ACCCUUUA | UAAAGGCUC UCUGUAUG |
| 6057 | UUCAUACA CUGAUGA X GAA AGAGCCUU | AAGGCUCUC UGUAUGAA |
| 6061 | UCUCUUCA CUGAUGA X GAA ACAGAGAG | CUCUCUCUA UGAAGAGA |
| 6079 | GUGCUGAU CUGAUGA X GAA ACCCUCCC | GGGACCGUC AUCAGCAC |
| 6082 | AAUGUGCU CUGAUGA X GAA AUGACGGU | ACCGUCAUC AGCACAUU |
| 6090 | CACUAGGG CUGAUGA X GAA AUGUGCUG | CAGCACAUU CCCUAGUG |
| 6091 | UCACUAGG CUGAUGA X GAA AAUGUGCU | AGCACAUUC CCUAGUGA |
| 6095 | AGGCUCAC CUGAUGA X GAA AGGGAAUG | CAUUCCCCA GUGAGCCU |
| 6104 | GGAGCCAG CUGAUGA X GAA AGGCUCAC | GUGAGCCUA CUGGCUCC |
| 6111 | GCUGCCAG CUGAUGA X GAA AGCCAGGA | UACUGGCUC CUGGCAGC |
| 6124 | UUCCACAA CUGAUGA X GAA AGCCGCUG | CAGCGGCUU UGUGGAA |
| 6125 | CUUCCACA CUGAUGA X GAA AAGCCGCU | AGCGGCUUU UGUCGAAG |
| 6126 | UCUUCCAC CUGAUGA X GAA AAAGCCGC | GCGGCUUUU GGGAAGA |
| 6137 | UGGCUAGU CUGAUGA X GAA AGUCUUCC | GGAAGACUC ACUAGCCA |
| 6141 | CUUCUGGC CUGAUGA X GAA AGUGAGUC | GACUCACUA GCCAGAAG |
| 6166 | GUGGAGAG CUGAUGA X GAA ACUGUCCC | GGGACAGUC CUCUCCAC |
| 6169 | UUGGUGGA CUGAUGA X GAA AGGACUGU | ACAGUCCUC UCCACCAA |
| 6171 | UCUUGGUG CUGAUGA X GAA AGAGGACU | AGUCCUCUC CACCAAGA |
| 6181 | UGGAUUUA CUGAUGA X GAA AUCUUGGU | ACCAAGAUC UAAAUCCA |
| 6183 | UUUCGAUU CUGAUGA X GAA AGGUCUUG | CAAGACUCA AAUCCAAA |
| 6187 | UUUGUUUG CUGAUGA X GAA AUUUAGAU | AUCUAAAUC CAAACAAA |
| 6204 | UCUGGCUC CUGAUGA X GAA AGCCUGCU | AGCAGGCUA GAGCCAGA |

TABLE II-continued

Human flt1 VEGF Receptor-Hammerhead Ribozyme and Substrate Sequence

| nt. Position | HH Ribozyme | Substrate |
|---|---|---|
| 6226 | ACAACAAA CUGAUGA X GAA AUUUGUCC | GGACAAAUC UUUGUUGU |
| 6228 | GAACAACA CUGAUGA X GAA AGAUUUGU | ACAAAUCUU UGUUGUUC |
| 6229 | GGAACAAC CUGAUGA X GAA AAGAUUUG | CAAAUCUUU GUUGUUCC |
| 6232 | AGAGGAAC CUGAUGA X GAA ACAAAGAU | AUCUUUGUU GUUCCUCU |
| 6235 | AGAAGAGG CUGAUGA X GAA ACAACAAA | UUUGUUGUU CCUCUUCU |
| 6236 | AAGAAGAG CUGAUGA X GAA AACAACAA | UUGUUGUUC CUCUUCUU |
| 6239 | GUAAAGAA CUGAUGA X GAA AGGAACAA | UUGUUCCUC UUCUUUAC |
| 6241 | GUGUAAAG CUGAUGA X GAA AGAGGAAC | GUUCCUCUU CUUUACAC |
| 6242 | UGUGUAAA CUGAUGA X GAA AAGAGGAA | UUCCUCUUC UUUACACA |
| 6244 | UAUGUAAA CUGAUGA X GAA AGAAGAGG | CCUCUUCUU UACACACA |
| 6245 | GUAUGUGU CUGAUGA X GAA AAGAAGAG | CUCUUCUUU ACACAUAC |
| 6246 | CGUAUGUG CUGAUGA X GAA AAAGAAGA | UCUUCUUUA CACAUACG |
| 6252 | GGUUUGCG CUGAUGA X GAA AUGUGUAA | UUACACAUA CGCAAACC |
| 6280 | AUUUAUAA CUGAUGA X GAA AUUGCCAG | CUGGCAAUU UUAUAAAU |
| 6281 | GAUUUAUA CUGAUGA X GAA AAUUGCCA | UGGCAAUUU UAUAAAUC |
| 6282 | UGAUUUAU CUGAUGA X GAA AAAUUGCC | GGCAAUUUU AUAAACCA |
| 6283 | CUGAUUUA CUGAUGA X GAA AAAAUUGC | GCAAUUUUA UAAAUCAG |
| 6285 | ACCUGAUU CUGAUGA X GAA AUAAAAUU | AAUUUUAUA AAUCAGGU |
| 6289 | AGUUACCU CUGAUGA X GAA AUUUAUAA | UUAUAAAUC AGGUAACU |
| 6294 | CUUCCAGU CUGAUGA X GAA ACCUGAUU | AAUCAGGUA ACUGGAAG |
| 6308 | CUGAGUUU CUGAUGA X GAA ACCUCCUU | AAGGAGGUU AAACUCAG |
| 6309 | UCUGAGUU CUGAUGA X GAA AACCUCCU | AGGAGGUUA AACUCAGA |
| 6314 | UUUUUUCU CUGAUGA X GAA AGUUUAAC | GUUAAACUC AGAAAAAA |
| 6331 | AAUUGACU CUGAUGA X GAA AGGUCUUC | GAAGACCUC AGUCAAUU |
| 6335 | AGAGAAUU CUGAUGA X GAA ACUGACGU | ACCUCAGUC AAUUCUCU |
| 6339 | AAGUAGAG CUGAUGA X GAA AUUGACUG | CAGUCAAUU CUCUACUU |
| 6340 | AAAGUAGA CUGAUGA X GAA AAUUGACU | AGUCAAUUC UCUACUUU |
| 6342 | AAAAGUA CUGAUGA X GAA AGAAUUGA | UCAAUUCUC UACUUUUU |
| 6344 | AAAAAAG CUGAUGA X GAA AGAGAAUU | AAUUCUCUA CUUUUUUU |
| 6347 | AAAAAAAA CUGAUGA X GAA AGUAGAGA | UCUCUACUU UUUUUUUU |
| 6348 | AAAAAAAA CUGAUGA X GAA AAGUAGAG | CUCUACUUU UUUUUUUU |
| 6349 | AAAAAAAA CUGAUGA X GAA AAAGUAGA | UCUACUUUU UUUUUUUU |
| 6350 | AAAAAAAA CUGAUGA X GAA AAAAGUAG | CUACUUUUU UUUUUUUU |
| 6351 | AAAAAAAA CUGAUGA X GAA AAAAAGUA | UACUUUUUU UUUUUUUU |
| 6352 | AAAAAAAA CUGAUGA X GAA AAAAAAGU | ACUUUUUUU UUUUUUUU |
| 6353 | AAAAAAAA CUGAUGA X GAA AAAAAAAG | CUUUUUUUU UUUUUUUU |

TABLE II-continued

Human flt1 VEGF Receptor-Hammerhead Ribozyme and Substrate Sequence

| nt. Position | HH Ribozyme | Substrate |
|---|---|---|
| 6354 | GAAAAAAA CUGAUGA X GAA AAAAAAA | UUUUUUUUU UUUUUUUC |
| 6355 | GGAAAAAA CUGAUGA X GAA AAAAAAA | UUUUUUUUU UUUUUUCC |
| 6356 | UGGAAAAA CUGAUGA X GAA AAAAAAA | UUUUUUUUU UUUUUCCA |
| 6357 | UUGGAAAA CUGAUGA X GAA AAAAAAA | UUUUUUUUU UUUUCCAA |
| 6358 | UUUGGAAA CUGAUGA X GAA AAAAAAA | UUUUUUUUU UUUCCAAA |
| 6359 | AUUUGGAA CUGAUGA X GAA AAAAAAA | UUUUUUUUU UUCCAAAU |
| 6360 | GAUUUGGA CUGAUGA X GAA AAAAAAA | UUUUUUUUU UCCAAAUC |
| 6361 | UGAUUUGG CUGAUGA X GAA AAAAAAA | UUUUUUUUU CCAAAUCA |
| 6362 | CUGAUUUG CUGAUGA X GAA AAAAAAA | UUUUUUUUC CAAAUCAG |
| 6368 | UAUUAUCU CUGAUGA X GAA AUUUGGAA | UUCCAAAUC AGAUAAUA |
| 6373 | UGGGCUAU CUGAUGA X GAA AUCUGAUU | AAUCAGAUA AUAGCCCA |
| 6376 | UGCUGGGC CUGAUGA X GAA AUUAUCUG | CAGAUAAUA GCCCAGCA |
| 6388 | GUUAUCAC CUGAUGA X GAA AUUUGCUG | CAGCAAAUA GUGAUAAC |
| 6394 | UUAUUUGU CUGAUGA X GAA AUCACUUU | AUAGUGAUA ACAAAUAA |
| 6401 | UAAGGUUU CUGAUGA X GAA AUUUGUUA | UAACAAAUA AAACCUUA |
| 6408 | GAACAGCU CUGAUGA X GAA AGGUUUUA | UAAAACCUU AGCUGUUC |
| 6409 | UGAACAGC CUGAUGA X GAA AAGGUUUU | AAAACCUUA GCUGUUCA |
| 6415 | AAGACAUG CUGAUGA X GAA ACAGCUAA | UUAGCUGUU CAUGUCUU |
| 6416 | CAAGACAU CUGAUGA X GAA AACAGCUA | UAGCUGUUC AUGUCUUG |
| 6421 | GAAAUCAA CUGAUGA X GAA ACAUGAAC | GUUCAUGUC UUGAUUUC |
| 6423 | UUGAAAUC CUGAUGA X GAA AGACAUGA | UCAUGUCUU GAUUUCAA |
| 6427 | AUUAUUGA CUGAUGA X GAA AUGAAGAC | GUCUUGAUU UCAAUAAU |
| 6428 | AAUUAUUG CUGAUGA X GAA AAUCAAGA | UCUUGAUUU CAAUAAUU |
| 6429 | UAAUUAUU CUGAUGA X GAA AAAUCAAG | CUUGAUUUC AAUAAUUA |
| 6433 | GAAUUAAU CUGAUGA X GAA AUUGAAAU | AUUUCAAUA AUUAAUUC |
| 6436 | UAAGAAUU CUGAUGA X GAA AUUAUUGA | UCAAUAAUU AAUUCUUA |
| 6437 | UUAAGAAU CUGAUGA X GAA AAUUAUUG | CAAUAAUUA AUUCUUAA |
| 6440 | UGAUUAAG CUGAUGA X GAA AUUAAUUA | UAAUUAAUU CUUAAUCA |
| 6441 | AUGAUUAA CUGAUGA X GAA AAUUAAUU | AAUUAAUUC UUAAUCAU |
| 6443 | UAAUGAUU CUGAUGA X GAA AGAAUUAA | UUAAUUCUU AAUCAUUA |
| 6444 | UUAAUGAU CUGAUGA X GAA AAGAAUUA | UAAUUCUUA AUCAUUAA |
| 6447 | CUCUUAAU CUGAUGA X GAA AUUAAGAA | UUCUUAAUC AUUAAGAG |
| 6450 | GGUCUCUU CUGAUGA X GAA AUGAUUAA | UUAAUCAUU AAGAGACC |
| 6451 | UGGUCUCU CUGAUGA X GAA AAUGAUUA | UAAUCAUUA AGAGACCA |
| 6461 | GUAUUUAU CUGAUGA X GAA AUGGUCUC | GAGACCAUA AUAAAUAC |
| 6464 | GGAGUAUU CUGAUGA X GAA AUUAUGGU | ACCAUAAUA AAUACUCC |
| 6468 | AAAAGGAG CUGAUGA X GAA AUUUAUUA | UAAUAAAUA CUCCUUUU |

TABLE II-continued

Human flt1 VEGF Receptor-Hammerhead Ribozyme and Substrate Sequence

| nt. Position | HH Ribozyme | Substrate |
|---|---|---|
| 6471 | UGGAAAAG CUGAUGA X GAA AGUAUUUA | UAAAUACUC CUUUUCAA |
| 6474 | CUCUUGAA CUGAUGA X GAA AGGAGUAU | AUACCCUU UUCAAGAG |
| 6475 | UCUCUUGA CUGAUGA X GAA AAGGAGUA | UACUCCUUU UAAGAGA |
| 6476 | UUCUCUUG CUGAUGA X GAA AAAGGAGU | ACUCCUUUU CAAGAGAA |
| 6477 | UUUCUCUU CUGAUGA X GAA AAAAGGAG | CUCUUUUUC AAGAGAAA |
| 6497 | ACAAUUCU CUGAUGA X GAA AUGGUUUU | AAAACCAUU AGAAUUGU |
| 6498 | AACAAUUC CUGAUGA X GAA AAUGGUUU | AAACCAUUA GAAUUGUU |
| 6503 | UGAGUAAC CUGAUGA X GAA AUUCUAAU | AUUAGAAUU GUUACUCA |
| 6506 | AGCUGAGU CUGAUGA X GAA ACAAUUCU | AGAAUUGUU ACUCAGCU |
| 6507 | GAGCUGAG CUGAUGA X GAA AACAAUUC | GAAUUGUUA CUCAGCUC |
| 6510 | AAGGAGCU CUGAUGA X GAA AGUAACAA | UUGUUACUC AGCUCCUU |
| 6515 | GUUUGAAG CUGAUGA X GAA AGCUGAGU | ACUCAGCUC CUUCAAAC |
| 6518 | UGAGUUUG CUGAUGA X GAA AGGAGCUG | CAGCUCCUU CAAACUCA |
| 6519 | CUGAGUUU CUGAUGA X GAA AAGGAGCU | AGCUCCUUC AAACUCAG |
| 6525 | ACAAACCU CUGAUGA X GAA AGUUUGAA | UUCAAACUC AGGUUUGU |
| 6530 | AUGCUACA CUGAUGA X GAA ACCUGAGU | ACUCAGGUU UGUAGCAU |
| 6531 | UAUGCUAC CUGAUGA X GAA AACCUGAG | CUCAGGUUU GUAGCAUA |
| 6534 | AUGUAUGC CUGAUGA X GAA ACAAACCU | AGGUUUGUA GCAUACAU |
| 6539 | GACUCAUG CUGAUGA X GAA AUGCUACA | UGUAGCAUA CAUGAGUC |
| 6547 | GAAGGAUG CUGAUGA X GAA ACUCAUGU | ACAUGAGUC CAUCCAUC |
| 6551 | GACUGAUG CUGAUGA X GAA AUGGACUC | GAGUCCAUC CAUCAGUC |
| 6555 | CUUUGACU CUGAUGA X GAA AUGGAUGG | CCAUCCAUC AGUCAAAG |
| 6559 | CAUUCUUU CUGAUGA X GAA ACUGAUGG | CCAUCAGUC AAAGAAUG |
| 6570 | CCAGAUGG CUGAUGA X GAA ACCAUUCU | AGAAUGGUU CCAUCUGG |
| 6571 | UCCAGAUG CUGAUGA X GAA AACCAUUC | GAAUGGUUC CAUCUGGA |
| 6575 | AGACUCCA CUGAUGA X GAA AUGGAACC | GGUUCCAUC UGGAGUCU |
| 6582 | UACAUUAA CUGAUGA X GAA ACUCCAGA | UCUGGAGUC UUAAUGUA |
| 6584 | UCUACAUU CUGAUGA X GAA AGACUCCA | UGGAGUCUU AAUGUAGA |
| 6585 | UUCUACAU CUGAUGA X GAA AAGACUCC | GGAGUCUUA AUGUAGAA |
| 6590 | UUUCUUUC CUGAUGA X GAA ACAUUAAG | CUUAAUGUA GAAAGAAA |
| 6609 | AUUAUUAC CUGAUGA X GAA AGUCUCCA | UGGAGACUU GUAAUAAU |
| 6612 | CUCAUUUU CUGAUGA X GAA ACAAGUCU | AGACUUGUA AUAAUGAG |
| 6615 | UAGCUCAU CUGAUGA X GAA AUUACAAG | CUUGUAAUA AUGAGCUA |
| 6623 | UUUGUAAC CUGAUGA X GAA AGCUCAUU | AAUGAGCUA GUUACAAA |
| 6626 | CACUUUGU CUGAUGA X GAA ACUAGCUC | GAGCUAGUU ACAAAGUG |
| 6627 | GCACUUUG CUGAUGA X GAA AACUAGCU | AGCUAGUUA CAAAGUGC |

TABLE II-continued

Human flt1 VEGF Receptor-Hammerhead Ribozyme and Substrate Sequence

| nt. Position | HH Ribozyme | Substrate |
|---|---|---|
| 6637 | UAAUGAAC CUGAUGA X GAA AGCACUUU | AAAGUGCUU GUUCAUUA |
| 6640 | UUUUAAUG CUGAUGA X GAA ACAAGCAC | GUGCUUGUU CAUUAAAA |
| 6641 | AUUUUAAU CUGAUGA X GAA AACAAGCA | UGCUUGUUC AUUAAAAU |
| 6644 | GCUAUUUU CUGAUGA X GAA AUGAACAA | UUGUUCAUU AAAAUAGC |
| 6645 | UGCUAUUU CUGAUGA X GAA AAUGAACA | UGUUCAUUA AAAUAGCA |
| 6650 | UUCAGUGC CUGAUGA X GAA AUUUUAUU | AUUAAAAUA GCACUGAA |
| 6662 | CAUGUUUC CUGAUGA X GAA AUUUUCAG | CUGAAAAUU GAAACAUG |
| 6674 | UAUCAGUU CUGAUGA X GAA AUUCAUGU | ACAUGAAUU AACUGAUA |
| 6675 | UUAUCAGU CUGAUGA X GAA AAUUCAUG | CAUGAAUUA ACUGAUAA |
| 6682 | UGGAAUAU CUGAUGA X GAA AUCAGUUA | UAACUGAUA AUAUUCCA |
| 6685 | GAUUGGAA CUGAUGA X GAA AUUAUCAG | CUGAUAAUA UUCCAAUC |
| 6687 | AUGAUUGG CUGAUGA X GAA AUAUUAUC | GAUAAUAUU CCAAUCAU |
| 6688 | AAUGAUUG CUGAUGA X GAA AAUAUUAU | AUAAUAUUC CAAUCAUU |
| 6693 | UGGCAAAU CUGAUGA X GAA AUUGGAAU | AUUCCAAUC AUUUGCCA |
| 6696 | AAAUGGCA CUGAUGA X GAA AUGAUUGG | CCAAUCAUU UGCCAUUU |
| 6697 | UAAAUGGC CUGAUGA X GAA AAUGAUUG | CAAUCAUUU GCCAUUUA |
| 6703 | UUGUCAUA CUGAUGA X GAA AUGGCAAA | UUUGCCAUU UAUGACAA |
| 6704 | UUUGUCAU CUGAUGA X GAA AAUGGCAA | UUGCCAUUU AUGACAAA |
| 6705 | UUUUGCCA CUGAUGA X GAA AAAUGGCA | UGCCAUUUA UGACAAAA |
| 6719 | UUAGUGCC CUGAUGA X GAA ACCAUUUU | AAAAUGGUU CCCACUAA |
| 6726 | UUCUUUGU CUGAUGA X GAA AGUGCCAA | UUGGCACUA ACAAAGAA |
| 6743 | CUGAAAGG CUGAUGA X GAA AGUGCUCG | CGAGCACUU CCUUUCAG |
| 6744 | UCUGAAAG CUGAUGA X GAA AAGUGCUC | GAGCACUUC CUUUCAGA |
| 6747 | AACUCUGA CUGAUGA X GAA AGGAAGUG | CACUUCCUU UCAGAGUU |
| 6748 | AAACUCUG CUGAUGA X GAA AAGGAAGU | ACUUCCUUU CAGACUUU |
| 6749 | GAAACCCU CUGAUGA X GAA AAACGAAG | CUCCUUUUC AGAGUUUC |
| 6755 | AUCUCAGA CUGAUGA X GAA ACUCUGAA | UUCAGAGUU UCUGACAU |
| 6756 | UAUCUCAG CUGAUGA X GAA AACUCUGA | UCAGAGUUU CUGAGAUA |
| 6757 | UUAUCUCA CUGAUGA X GAA AAACUCUG | CAGAGUUUC UGAGAUAA |
| 6764 | ACGUACAU CUGAUGA X GAA AUCUCAGA | UCUGAGAAA AUGUACGU |
| 6769 | GUUCCACG CUGAUGA X GAA ACAUUAUC | GAUAAUGUA CGUGCAAC |
| 6781 | UCCACCCA CUGAUGA X GAA ACUGUUCC | GGAACAGUC UGGGUGGA |
| 6814 | AAGACACA CUGAUGA X GAA ACUUGCAC | GUGCAACUC UGUGUCUU |
| 6820 | ACUGACAA CUGAUGA X GAA ACACAGAC | GUCUGUGUC UUGUCAGU |
| 6822 | GGACUGAC CUGAUGA X GAA AGACACAG | CUGUGUCUU GUCAGUCC |
| 6825 | CUUGGACU CUGAUGA X GAA ACAAACCA | UGUCUUGUC AGUCCAAG |
| 6829 | ACUUCUUG CUGAUGA X GAA ACUGACAA | UUGUCAGUC CAAGAAGU |

TABLE II-continued

Human flt1 VEGF Receptor-Hammerhead Ribozyme and Substrate Sequence

| nt. Position | HH Ribozyme | Substrate |
|---|---|---|
| 6851 | CUAAAAUU CUGAUGA X GAA ACAUCUCG | CGAGAUGUU AAUUUUAG |
| 6852 | CCUAAAAU CUGAUGA X GAA AACAUCCC | GAGAUGUUA AUUUUAGG |
| 6855 | GUCCCUAA CUGAUGA X GAA AUUAACAU | AUGUUAAUU UUAGGGAC |
| 6856 | GGUCCCUA CUGAUGA X GAA AAUUAACA | UGUUAAUUU UAGGGACC |
| 6857 | GGGUCCCU CUGAUGA X GAA AAAUUAAC | GUUAAUUUU AGGGACCC |
| 6858 | CGGGUCCC CUGAUGA X GAA AAAAUUAA | UUAAUUUUA GGGACCCG |
| 6872 | UAGGGAAC CUGAUGA X GAA AGGCACGG | CCGUGCCUU GUUUCCUA |
| 6875 | GGCUAGGA CUGAUGA X GAA ACAACGCA | UGCCUUGUU UCCUAGCC |
| 6876 | GGGCUAGG CUGAUGA X GAA AACAAGGC | GCCUUGUUU CCUAGCCC |
| 6877 | UGGGCUAG CUGAUGA X GAA AAACAAGG | CCUUGUUUC CUCGCCCA |
| 6880 | UUGUGGGC CUGAUGA X GAA AGGAAACA | UGUUCCUA GCCCACAA |
| 6901 | AUCUGUUU CUGAUGA X GAA AUGUUUGC | GCAAACAUC AAACAGAU |
| 6910 | CUAGCGAG CUGAUGA X GAA AUCUGUUU | AAACAGAUA CUCGCUAG |
| 6913 | AGGCUAGC CUGAUGA X GAA AGUGUCUC | CAGAUACUC GCUAGCCU |
| 6917 | AAUGAGGC CUGAUGA X GAA AGCGAGUA | UACUCGCUA GCCUCAUU |
| 6922 | AUUUAAAU CUGAUGA X GAA AGGCUAGC | GCUAGCCUC AUUUAAAU |
| 6925 | UCAAUUUA CUGAUGA X GAA AUGAGGCU | AGCCUCAUU UAAAUUGA |
| 6926 | AUCAAUUU CUGAUGA X GAA AAUGAGGC | GCCUCAUUU AAAUUGAU |
| 6927 | AAUCAAUU CUGAUGA X GAA AAAUGAGG | CCUCAUUUA AAUUGAUU |
| 6931 | CUUUAAUC CUGAUGA X GAA AUUUAAAU | AUUUAAAUU GAUUAAAG |
| 6935 | CCUCCUUU CUGAUGA X GAA AUCAAUUU | AAAUUGAUU AAAGGAGG |
| 6936 | UCCUCCUU CUGAUGA X GAA AAUCAAUU | AAUUGAUUA AAGGAGGA |
| 6951 | CGGCCAAA CUGAUGA X GAA AAGCACUC | GAGUGCAUC UUUGGCCG |
| 6953 | GUCGGCCA CUGAUGA X GAA AGAUGCAC | GUGCAUCUU UGGCCGAC |
| 6954 | UGUCGGCC CUGAUGA X GAA AAGAUGCA | UGCAUCUUU GGCCGACA |
| 6970 | CACACAGU CUGAUGA X GAA ACACCACU | AGUGGUGUA ACUGUGUG |
| 7026 | AACACACA CUGAUGA X GAA ACACCCAC | GUGGGUGUA UGUGUGUU |
| 7034 | AUGCACAA CUGAUGA X GAA ACACACAU | AUGUGUGUU UUGUGCAU |
| 7035 | UAUGCACA CUGAUGA X GAA AACACACA | UGUGUGUUU UGUGCAUA |
| 7036 | UAUGCACA CUGAUGA X GAA AAACACAC | GUGUGUUUU GUGCAUAA |
| 7043 | UAAAUAGU CUGAUGA X GAA AUGCACAA | UUGUGCAUA ACUAUUUA |
| 7047 | UCCUUAAA CUGAUGA X GAA AGUUAUGC | GCAUAACUA UUUAAGGA |
| 7049 | UUUCCUUA CUGAUGA X GAA AUAGUGAU | AUAACUAUU UAGGAAA |
| 7050 | GUUUCCUU CUGAUGA X GAA AAUAGUUA | UAACUAUUU AGGGAAAC |
| 7051 | AGUUUCCU CUGAUGA X GAA AAAUAGUU | AACCAUUUA AAGAAACU |
| 7065 | AACUUUAA CUGAUGA X GAA AUUCCAGU | ACUGGAAUU UUAAGUU |

TABLE II-continued

Human flt1 VEGF Receptor-Hammerhead Ribozyme and Substrate Sequence

| nt. Position | HH Ribozyme | Substrate |
|---|---|---|
| 7066 | UAACUUAA CUGAUGA X GAA AAUUCCAG | CUGGAAUUU UAAAGUUA |
| 7067 | GUAACUUU CUGAUGA X GAA AAAUUCCA | UGGAAUUUU AAAGUUAC |
| 7068 | AGGAACUU CUGAUGA X GAA AAAAUUCC | GGAAUUUUA AAGUUACU |
| 7073 | AUAAAAGU CUGAUGA X GAA ACUUUAAA | UUUAAAGUU ACUUUUAU |
| 7074 | UAUAAAAG CUGAUGA X GAA AACUUUAA | UUAAAGUUA CUUUUAUA |
| 7077 | UUGUAUAA CUGAUGA X GAA AGUAACUU | AAGUUACUU UUAUACAA |
| 7078 | UUUGUAUA CUGAUGA X GAA AAGUAACU | AGUUACUUU UAUACAAA |
| 7079 | GUUUGUAU CUGAUGA X GAA AAAGUAAC | GUUACUUUU AUACAAAC |
| 7080 | GGUUUGUA CUGAUGA X GAA AAAAGUAA | UUACUUUUA UACAAACC |
| 7082 | UUGGUUUG CUGAUGA X GAA AUAAAAGU | ACUUUCAUA CAAACCAA |
| 7095 | GUAGCUUA CUGAUGA X GAA AUUCUUGG | CCAAGAAUA UAUGCUAC |
| 7097 | CUGUAGCA CUGAUGA X GAA AUAUUCUU | AAGAAUAUA UGCUACAG |
| 7102 | UAUAUCUG CUGAUGA X GAA AGCAUAUA | UAUAUGCUA CAGAUAUA |
| 7108 | CUGUCUUA CUGAUGA X GAA AUCUGUAG | CUACAGAUA UAAGACAG |
| 7110 | GCCUGUCU CUGAUGA X GAA AUAUCUGU | ACAGAUAUA AGACAGAC |
| 7124 | UAGGACCA CUGAUGA X GAA ACCAUGCC | GACAUGGUU UGGUCCUA |
| 7125 | AUAGGACC CUGAUGA X GAA AACCAUGU | ACAUGGUUU GCUCUUAU |
| 7129 | AAAUAUAG CUGAUGA X GAA ACCAAACC | GGUUUGGUC CUAUAUUU |
| 7132 | UAGAAAUA CUGAUGA X GAA AGGACCAA | UUGGUCCUA UAUUUCUA |
| 7134 | ACUAGAAA CUGAUGA X GAA AUAGGACC | GGUCCUAUA UUUCUAGU |
| 7136 | UGACUAGA CUGAUGA X GAA AUAUAGGA | UCCUAUAUU UCUAGUCA |
| 7137 | AUGACUAG CUGAUGA X GAA AAUAUAGG | CCUAUAUUU CUAGUCAU |
| 7138 | CAUGACUA CUGAUGA X GAA AAAUAUAG | CUAUAUUUC UAGUCAUG |
| 7140 | AUCAUGAC CUGAUGA X GAA AGAAAUAU | AUAUUUCUA GUCAUGAU |
| 7143 | UUCAUCAU CUGAUGA X GAA ACUAGAAA | UUUCUAGUC AUGAUGAA |
| 7155 | AUACAAAA CUGAUGA X GAA ACAUUCAU | AUGAAUGUA UUUUGUAU |
| 7157 | GUAUACAA CUGAUGA X GAA AUACAUUC | GAAUGUAUU UUGUAUAC |
| 7158 | GGUAUACA CUGAUGA X GAA AAUACAUU | AAUGUAUUU UGUAUACC |
| 7159 | UGGUAUAC CUGAUGA X GAA AAAUACAU | AUGUAUUUU GUAUACCA |
| 7162 | AGAUGGUA CUGAUGA X GAA ACAAAAUA | UAUUUUGUA UACCAUCU |
| 7164 | GAAGAUGG CUGAUGA X GAA AUACAAAA | UUUUGUAUA CCAUCUUC |
| 7169 | UAUAUGAA CUGAUGA X GAA AUGGUAUA | UAUACCAUC UUCAUAUA |
| 7171 | AUUAUAUG CUGAUGA X GAA AGAUGGUA | UACCAUCUU CAUAUAAU |
| 7172 | UAUUAUAU CUGAUGA X GAA AAGAUGGU | ACCAUCUUC AUAUAAUA |
| 7175 | GUAUAUUA CUGAUGA X GAA AUGAAGAU | AUCUUCAUA UAAUAUAC |
| 7177 | AAGUAUAU CUGAUGA X GAA AUAUGAAG | CUUCAUAUA AUAUACUU |
| 7180 | UUUAAGUA CUGAUGA X GAA AUUAUAUG | CAUAUAAUA UACUUAAA |

TABLE II-continued

Human flt1 VEGF Receptor-Hammerhead Ribozyme and Substrate Sequence

| nt. Position | HH Ribozyme | Substrate |
|---|---|---|
| 7182 | UUUUUAAG CUGAUGA X GAA AUAUUAUA | UAUAAUAUA CUUAAAAA |
| 7185 | AUAUUUUU CUGAUGA X GAA AGUAUAUU | AAUAUACUU AAAAAUAU |
| 7186 | AAUAUUUU CUGAUGA X GAA AAGUAUAU | AUAUACUUA AAAAUAUU |
| 7192 | UUAAGAAA CUGAUGA X GAA AUUUUUAA | UUAAAAAUA UUUCUUAA |
| 7194 | AAUUAAGA CUGAUGA X GAA AUAUUUUU | AAAAAUAUU UCUUAAUU |
| 7195 | CAAUUAAG CUGAUGA X GAA AAUAUUUU | AAAAUAUUU CUUAAUUG |
| 7196 | CCAAUUAA CUGAUGA X GAA AAAUAUUU | AAAUAUUUC UUAAUUGG |
| 7198 | UCCCAAUU CUGAUGA X GAA AGAAAUAU | AUAUUUCUU AAUUGGGA |
| 7199 | AUCCCAAU CUGAUGA X GAA AAGAAAUA | UAUUUCUUA AUUGGGAU |
| 7202 | CAAAUCCC CUGAUGA X GAA AUUAAGAA | UUCUUAAUU GGGAUUUG |
| 7208 | CGAUUACA CUGAUGA X GAA AUCCCAAU | AUUGGGAUU UGUAAUCG |
| 7209 | ACGAUUAC CUGAUGA X GAA AAUCCCAA | UUGGGAUUU GUAAUCGU |
| 7212 | GGUACGAU CUGAUGA X GAA ACAAAUCC | GGAUUUGUA AUCGUACC |
| 7215 | GUUGGUAC CUGAUGA X GAA AUUACAAA | UUUGUAAUC GUACCAAC |
| 7218 | UAAGUUCG CUGAUGA X GAA ACGAUUAC | GUAAUCGUA CCAACUUA |
| 7225 | UAUCAAUU CUGAUGA X GAA AGUUGGUA | UACCAACUU AAUUGAUA |
| 7226 | UUAUCAAU CUGAUGA X GAA AAGUUGGU | ACCAACUUA AUUGAUAA |
| 7229 | AGUUUAUC CUGAUGA X GAA AUUAAGUU | AACUUAAUU GAUAAACU |
| 7233 | GCCAAGUU CUGAUGA X GAA AUCAAUUA | UAAUUGAUA AACUUGGC |
| 7238 | CAGUUGCC CUGAUGA X GAA AGUUUAUC | GAUAAACUU GGCAACUG |
| 7249 | GAACAUAA CUGAUGA X GAA AGCAGUUG | CAACUGCUU UUAUGUUC |
| 7250 | AGAACAUA CUGAUGA X GAA AAGCAGUU | AACUGCUUU UAUGUUCU |
| 7251 | CAGAACAU CUGAUGA X GAA AAAGCAGU | ACUGCUUUU AUUUCUG |
| 7252 | ACAGAACA CUGAUGA X GAA AAAAGCAG | CUGCUUUUA UGUUCUGU |
| 7256 | GAAGACAG CUGAUGA X GAA ACAUAAAA | UUUUAUGUU CUGUCUCC |
| 7257 | AAGAGACA CUGAUGA X GAA AACAUAAA | UUUAUGUUC UGUCUCCU |
| 7261 | UGGAAGGA CUGAUGA X GAA ACAGAACA | UGUUCUGUC UCCUUCCA |
| 7263 | UAUGGAAG CUGAUGA X GAA AGACAAAA | UUCUGUCUC CUUCCAUA |
| 7266 | AUUUAUGG CUGAUGA X GAA AGGAGACA | UGUCUCCUU CCAUAAAU |
| 7267 | AAUUUAUG CUGAUGA X GAA AAGGAGAC | GUCUCCUUC CAUAAAUU |
| 7271 | GAAAAAUU CUGAUGA X GAA AUGGAAGG | CCUUCCAUA AAUUUUUC |
| 7275 | UUUUGAAA CUGAUGA X GAA AUUUAUGG | CCAUAAAUU UUUCAAAA |
| 7276 | AUUUGAA CUGAUGA X GAA AAUUUAUG | CAUAAAUUU UUCAAAAU |
| 7277 | UAUUUUGA CUGAUGA X GAA AAAUUUAU | AUAAAUUUU UCAAAUA |
| 7278 | GUAUUUUG CUGAUGA X GAA AAAAUUUA | UAAAUUUUU CAAAAUAC |
| 7279 | AGUAUUUU CUGAUGA X GAA AAAAAUUU | AAAUUUUUC AAAAUACU |

TABLE II-continued

Human flt1 VEGF Receptor-Hammerhead Ribozyme and Substrate Sequence

| nt. Position | HH Ribozyme | Substrate |
|---|---|---|
| 7285 | UGAAUUAG CUGAUGA X GAA AUUUUGAA | UUCAAAAUA CUAAUUCA |
| 7288 | UGUUGAAU CUGAUGA X GAA AGUAUUUU | AAAAUACUA AUUCAACA |
| 7291 | CUUUGUUG CUGAUGA X GAA AUUAGUAU | AUACUAAUU CAACAAAG |
| 7292 | UCUUUCUU CUGAUGA X GAA AAUUAGUA | UACUAAUUC AACAAAGA |
| 7308 | AAAAAAAA CUGAUGA X GAA AGCUUUUU | AAAAGCUC UUUUUUUU |
| 7310 | GGAAAAAA CUGAUGA X GAA AGAGCUUU | AAAGCUCUU UUUUUUCC |
| 7311 | AGGAAAAA CUGAUGA X GAA AAGAGCUU | AAGCUCUUU UUUUUCCU |
| 7312 | UAGGAAAA CUGAUGA X GAA AAAGAGCU | AGCUCUUUU UUUUCCUA |
| 7313 | UUAGGAAA CUGAUGA X GAA AAAAGAGC | GCUCUUUUU UUUCCUAA |
| 7314 | UUUAGGAA CUGAUGA X GAA AAAAAGAG | CUCUUUUUU UUCCUAAA |
| 7315 | UUUUAGGA CUGAUGA X GAA AAAAAAGA | UCUUUUUUU UCCCAAAA |
| 7316 | AUUUUAGG CUGAUGA X GAA AAAAAAAG | CUUUUUUUU CCUAAAAU |
| 7317 | UAUUUUAG CUGAUGA X GAA AAAAAAAA | UUUUUUUUC CUAAAAUA |
| 7320 | GUUUAUUU CUGAUGA X GAA AGGAAAAA | UUUUUCCUA AAAUAAAC |
| 7325 | UUUGAGUU CUGAUGA X GAA AUUUUAGG | CCUAAAAUA AACUCAAA |
| 7330 | AUAAAUUU CUGAUGA X GAA AGUUUAUU | AAUAAACUC AAAUUUAU |
| 7335 | CAAUGAUA CUGAUGA X GAA AUUUGAGU | ACUCAAAUU UAUCCUUG |
| 7336 | ACAAGGAU CUGAUGA X GAA AAUUUAAG | CUCAAAUUU AUCCUUGU |
| 7337 | AACAAGGA CUGAUGA X GAA AAAUUUGA | UCAAADUUA UCCUUGUU |
| 7339 | UAAACAAG CUGAUGA X GAA AUAAAUUU | AAAUUUAUC CUUGUUUA |
| 7342 | CCCUAAAC CUGAUGA X GAA AGGAUAAA | UUUAUCCUU GUUUAGAG |
| 7345 | CUGCUCUA CUGAUGA X GAA ACAAGGAU | AUCCUUGUU UAGAGCAG |
| 7346 | UCUGCUCU CUGAUGA X GAA AACAAGGA | UCCUUGUUU AGAGCAGA |
| 7347 | CUCUGCUC CUGAUGA X GAA AAACAAGG | CCUUGUUUA GAGCAGAG |
| 7362 | UUUUUCUU CUGAUGA X GAA AUUUUUCU | AGAAAAAUU AAGAAAAA |
| 7363 | GUUUUUCU CUGAUGA X GAA AAUUUUUC | GAAAAAUUA AGAAAAAC |
| 7373 | CCAUUUCA CUGAUGA X GAA AGUUUUUC | GAAAAACUU UGAAAUGG |
| 7374 | ACCAUUUC CUGAUGA X GAA AAGUUUUU | AAAAACUUU GAAAUGGU |
| 7383 | UUUUUUGA CUGAUGA X GAA ACCAUUUC | GAAAUGGUC UCAAAAAA |
| 7385 | AAUUUUUU CUGAUGA X GAA AGACCAUU | AAUGGUCUC AAAAAAUU |
| 7393 | UAUUUAGC CUGAUGA X GAA AUUUUUUG | CAAAAAAUU GCUAAAUA |
| 7397 | AAAAUAUU CUGAUGA X GAA AGCAAUUU | AAAUUGCUA AAUAUUUU |
| 7401 | AUUGAAAA CUGAUGA X GAA AUUUAGCA | UGCUAAAUA UUUUCAAU |
| 7403 | CCAUUGAA CUGAUGA X GAA AUAUUUAG | CUAAAUAUU UUCAAUGG |
| 7404 | UCCAUUGA CUGAUGA X GAA AAUAUUUA | UAAAUAUUU UCAAUGGA |
| 7405 | UUCCAUUG CUGAUGA X GAA AAAUAUUU | AAAUAUUUU CAAUGGAA |
| 7406 | UUUCCAUU CUGAUGA X GAA AAAAUAUU | AAUAUUUUC AAUGGAAA |

TABLE II-continued

Human flt1 VEGF Receptor-Hammerhead Ribozyme and Substrate Sequence

| nt. Position | HH Ribozyme | Substrate |
|---|---|---|
| 7418 | CUAACAUU CUGAUGA X GAA AGUUUCC | GGAAAACUA AAUGUUAG |
| 7424 | GCUAAACU CUGAUGA X GAA ACAUUUAG | CUAAAUGUU AGUUUAGC |
| 7425 | AGCUAAAC CUGAUGA X GAA AACAUUUA | UAAAUGUUA GUUUAGCU |
| 7428 | AUCAGCUA CUGAUGA X GAA ACUAACAU | AUGUUAGUU UAGCUGAU |
| 7429 | AAUCAGCU CUGAUGA X GAA AACUAACA | UGUUAGUUU AGCUGAUU |
| 7430 | CAAUCAGC CUGAUGA X GAA AAACUAAC | GUUAGUUUA GCUGAUUG |
| 7437 | CCCCAUAC CUGAUGA X GAA AUCACCCA | UAGCUGAUU GUAUGGGG |
| 7440 | AAACCCCA CUGAUGA X GAA ACAAUCAG | CUGAUUGUA UGGGGUUU |
| 7447 | GGUUCGAA CUGAUGA X GAA ACCCCAUA | UAUGGGGUU UUCGAACC |
| 7448 | AGGUUCGA CUGAUGA X GAA AACCCCAU | AUGGGGUUU UCGAACCU |
| 7449 | AAGGUUCG CUGAUGA X GAA AAACCCCA | UGGGGUUUU CGAACCUU |
| 7450 | AAAGGUUC CUGAUGA X GAA AAAACCCC | GGGGUUUUC GAACCUUU |
| 7457 | AAAAGUGA CUGAUGA X GAA AGGUUCGA | UCGAACCUU UCACUUUU |
| 7458 | AAAAAGUG CUGAUGA X GAA AAGGUUCG | CGAACCUUU CACUUUUU |
| 7459 | CAAAAAGU CUGAUGA X GAA AAAGGUUC | GAACCUUUC ACUUUUUG |
| 7463 | CAAACAAA CUGAUGA X GAA AGUGAAAG | CUUUCACUU UUUGUUUG |
| 7464 | ACAAACAA CUGAUGA X GAA AAGUGAAA | UUUCACUUU UUGUUUGU |
| 7465 | AACAAACA CUGAUGA X GAA AAAGUGAA | UUCACUUUU UGUUUGUU |
| 7466 | AAACAAAC CUGAUGA X GAA AAAAGUGA | UCACUUUUU GUUUGUUU |
| 7469 | GUAAAACA CUGAUGA X GAA ACAAAAAG | CUUUUUGUU UGUUUUAC |
| 7470 | GGUAAAAC CUGAUGA X GAA AACAAAAA | UUUUUGUUU GUUUUACC |
| 7473 | AUAGGUAA CUGAUGA X GAA ACAAACAA | UUGUUUGUU UUACCUAU |
| 7474 | AAUAGAAA CUGAUGA X GAA AACAAACA | UGUUUGUUU UACCUAUU |
| 7475 | AAAUAGGU CUGAUGA X GAA AAACAAAC | GUUUGUUUU ACCUAUUU |
| 7476 | GAAAUAGG CUGAUGA X GAA AAAACAAA | UUUGUUUUA CCUAUUUC |
| 7480 | UUGUGAAA CUGAUGA X GAA AGGUAAAA | UUUUACCUA UUUCACAA |
| 7482 | AGUUGUGA CUGAUGA X GAA AUAGGUAA | UUACCUAUU UCACAACU |
| 7483 | CAGUUGUG CUGAUGA X GAA AAUAGGUA | UACCUAUUU CACAACAG |
| 7484 | ACAGUUGU CUGAUGA X GAA AAAUAGGU | ACCUAUUUC ACAACUGU |
| 7495 | UGGCAAUU CUGAUGA X GAA ACACAGUU | AACUGUGUA AAUUGCCA |
| 7499 | UUAUUGGC CUGAUGA X GAA AUUUACAC | GUGUAAAUU GCCACCAA |
| 7506 | ACAGGAAU CUGAUGA X GAA AUUGGCAA | UUGCCAAUA AUUCCUGU |
| 7509 | UGGACAGG CUGAUGA X GAA AUUAUUGG | CCAAUAAUU CCUGUCCA |
| 7510 | AUGGACAG CUGAUGA X GAA AAUUAUUG | CAAUAAUUC CUGUCCAU |
| 7515 | UUUUCAUG CUGAUGA X GAA ACAGGAAU | AUUCCUGUC CAUGAAAA |
| 7531 | CACUGGAU CUGAUGA X GAA AUUUGCAU | AUGCAAAUU AUCCAGUG |

TABLE II-continued

Human flt1 VEGF Receptor-Hammerhead Ribozyme and Substrate Sequence

| nt. Position | HH Ribozyme | Substrate |
|---|---|---|
| 7532 | ACACUGGA CUGAUGA X GAA AAUUUGCA | UGCAAAUUA UCCAGUGU |
| 7534 | CUACACUG CUGAUGA X GAA AUAAUUUG | CAAAUUAUC CAGUGUAG |
| 7541 | AAUAUAUC CUGAUGA X GAA ACACUGGA | UCCAGUGUA GAUAUAUU |
| 7545 | GUCAAAUA CUGAUGA X GAA AUCUACAC | GUGUAGAUA UAUUUGAC |
| 7547 | UGGUCAAA CUGAUGA X GAA AUAUCUAC | GUAGAUAUA UUUCACCA |
| 7549 | GAUGGUCA CUGAUGA X GAA AUAUAUCU | AGAUAUAUU UGACCAUC |
| 7550 | UGAUGGUC CUGAUGA X GAA AAUAUAUC | GAUAUAUUU GACCAUCA |
| 7557 | CAUAGGGU CUGAUGA X GAA AUGGUCAA | UUGACCAUC ACCCUAUG |
| 7563 | AAUACCCA CUGAUGA X GAA AGGGUGAU | AUCACCCUA UGGAUAUU |
| 7569 | CUAGCCAA CUGAUGA X GAA AUCCAUAG | CUAUGGAUA UUGGCUAG |
| 7571 | AACUAGCC CUGAUGA X GAA AUAUCCAU | AUGGAUAUU GGCUAGUU |
| 7576 | GGCAAAAC CUGAUGA X GAA AGCCAAUA | UAUUGGCUA GUUUUGCC |
| 7579 | AAAGGCAA CUGAUGA X GAA ACUAGUCA | UGGCUAGUU UUGCCUUU |
| 7580 | UAAAGCCA CUGAUGA X GAA AACUAGCC | GGCUAGUUU UGCCUUUA |
| 7581 | AUAAAGGC CUGAUGA X GAA AAACUAGC | GCUAGUUUU GCCUUUAU |
| 7586 | GCUUAAUA CUGAUGA X GAA AGGCAAAA | UUUUGCCUU UAUUAAGC |
| 7587 | UGCUUAAU CUGAUGA X GAA AAGGCAAA | UUUGCCUUU AUUAAGCA |
| 7588 | UUGCUUAA CUGAUGA X GAA AAAGGCAA | UUGCCUUUA UUAAGCAA |
| 7590 | AUUUGCUU CUGAUGA X GAA AUAAAGGC | GCCUUUAUU AAGCAAAU |
| 7591 | AAUUUGCU CUGAUGA X GAA AAUAAAGG | CCUUUAUUA AGCAAAUU |
| 7599 | CUGAAAUG CUGAUGA X GAA AUUUGCUU | AAGCAAAUU CAUUUCAG |
| 7600 | GCUGAAAU CUGAUGA X GAA AAUUUGCU | AGCAAAUUC AUUUCAGC |
| 7603 | CAGGCUGA CUGAUGA X GAA AUGAAUUU | AAAUUCAUU UCAGCCUG |
| 7604 | UCACGGUG CUGAUGA X GAA AAUGAAUU | AAUUCAUUU CAGCCUGA |
| 7605 | UUCAGGCU CUGAUGA X GAA AAAUGAAU | AUUCAUUUC AGCCUGAA |
| 7617 | UAUAGGCA CUGAUGA X GAA ACAUUCAG | CUGAAUGUC UGCCUAUA |
| 7623 | AGAAUAUA CUGAUGA X GAA ACGCAGAC | GUCUGCCUA UAUAUUCU |
| 7625 | AGAGAAUA CUGAUGA X GAA AUAGGCAG | CUGCCUAUA UAUUCUCU |
| 7627 | GCAGAGAA CUGAUGA X GAA AUAUAGGC | GCCUAUAUA UCCUCUCC |
| 7629 | GAGCAGAG CUGAUGA X GAA AUAUAUAG | CUAUAUAUU CUCUGCUC |
| 7630 | AGAGCAGA CUGAUGA X GAA AAUAUAUA | UAUAUAUUC UCUGCUCU |
| 7632 | AAAGACCA CUGAUGA X GAA AGAAUAUA | UAUAUUCUC UGCUCUUU |
| 7637 | AAUACAAA CUGAUGA X GAA ACCAGAGA | UCUCUGCUC UUUGUAUU |
| 7639 | AGAAUACA CUGAUGA X GAA AGAGCAGA | UCUGCUCUU UCUAUUCU |
| 7640 | GAGAAUAC CUGAUGA X GAA AAGAGCAG | CUGCUCUUU GUAUUCUC |
| 7643 | AAGGAGAA CUGAUGA X GAA ACAAACAG | CUCUUUGUA UUCUCCUU |
| 7645 | CAAACCAG CUGAUGA X GAA AUACAAAG | CUUUGUAUU CUCCUUUG |

TABLE II-continued

Human flt1 VEGF Receptor-Hammerhead Ribozyme and Substrate Sequence

| nt. Position | HH Ribozyme | Substrate |
|---|---|---|
| 7646 | UCAAAGGA CUGAUGA X GAA AAUACAAA | UUUGUAUUC UCCUUUGA |
| 7648 | CUUCAAAG CUGAUGA X GAA AGAAUACA | UUUUUUCUC CUUUGAAC |
| 7651 | CGGGUUCA CUGAUGA X GAA AGGAGAAU | AUUCUCCUU UGAACCCG |
| 7652 | ACGGGUUC CUGAUGA X GAA AAGGAGAA | UUCUCCUUU GAACCCGU |
| 7661 | GAUGUUUU CUGAUGA X GAA ACGGGUUC | GAACCCGUU AAAACAUC |
| 7662 | GGAUGUUU CUGAUGA X GAA AACGGGUU | AACCCGUUA AAACAUCC |
| 7669 | UGCCACAG CUGAUGA X GAA AUGUUUUA | UAAAACAUC CUGUGGCA |

Where "X" represents stem II region of a HH ribozyme (Hertel et al., 1992 Nucleic Acids Res. 20 3252). The length of stem II may be ≧ 2 base-pairs.

TABLE III

Human fLt1 VEGF Receptor-Hairpin Ribozyme and Substrate sequence

| nt. Position | HP Ribozyme Sequence | Substrate |
|---|---|---|
| 16 | CGGGGAGG AGAA GAGAGG ACCAGAGAAACACACGUUGUGGUACAUUACCUGGUA | CCUCUCG GCU CCUCCCCG |
| 39 | CCGCUCCG AGAA GCCGCC ACCAGAGAAACACACGUUGUGGUACAUUACCUGGUA | GGCGGCG GCU CGGAGCGG |
| 180 | CCGCCAGA AGAA GUCCUC ACCAGAGAAACACACGUUGUGGUACAUUACCUGGUA | GAGGACG GAC UCUGGCGG |
| 190 | AACGACCC AGAA GCCAGA ACCAGAGAAACACACGUUGUGGUACAUUACCUGGUA | UCUGGCG GCC GGGUCGUU |
| 278 | GCGCGCAC AGAA GGACCC ACCAGAGAAACACACGUUGUGGUACAUUACCUGGUA | GGGUCCU GCU GUGCGCGC |
| 290 | GACAGCUG AGAA GCGCGC ACCAGAGAAACACACGUUGUGGUACAUUACCUGGUA | GCGCGCU GCU CAGCUGUC |
| 295 | AAGCGAGAC AGAA GAGCAG ACCAGAGAAACACACGUUGUGGUACAUUACCUGGUA | CUGCUCA GCU GUCUGCUU |
| 298 | GAGAAGCA AGAA GCUGAG ACCAGAGAAACACACGUUGUGGUACAUUACCUGGUA | CUCAGCU GUC UGCUUCUC |
| 302 | CUGUGAGA AGAA GACAGC ACCAGAGAAACACACGUUGUGGUACAUUACCUGGUA | GCUGUCU GCU UCUCACAG |
| 420 | CAUUUAUG AGAA GCUUCC ACCAGAGAAACACACGUUGUGGUACAUUACCUGGUA | GGAAGCA GCC CAUAAAUG |
| 486 | CUUCCACA AGAA GAUUUA ACCAGACAAACACACGUUGUGGUACAUUACCUGGUA | UAAAUCU GCC UGUGGAAG |
| 537 | UUUGCUUG AGAA GUGUUC ACCAGAGAAACACACGUUGUGGUACAUUACCUGGUA | GAACACA GCU CAAGCAAA |
| 565 | AUAUUUGC AGAA GUAGAA ACCAGAGAAACACACGUUGUGGUACAUUACCUGGUA | UUCUACA GCU GCAAAUAU |
| 721 | CGUAACCC AGAA GGGAAU ACCAGAGAAACACACGUUGUGGUACAUUACCUGGUA | AUUCCCU GCC GGGUUACG |
| 786 | CGUUUUCC AGAA GGGAUC ACCAGAGAAACACACGUUGUGGUACAUUACCUGGUA | GAUCCCU GAU GGAAAACG |
| 863 | CUUCACAG AGAA GAAGCC ACCAGAGAAACACACGUUGUGGUACAUUACCUGGUA | GGCUUCU GAC CUGUGAAG |
| 1056 | UUUUUUUC AGAA GGGUAA ACCAGAGAAACACACGUUGUGGUACAUUACCUGGUA | UUACCCU GAU GAAAAAAA |
| 1301 | GCCGGUAA AGAA GCUUGC ACCAGAGAAACACACGUUGUGGUACAUUACCUGGUA | GCAAGCG GUC UUACCGGC |
| 1310 | UCAUAGAG AGAA GGUAAG ACCAGAGAAACACACGUUGUGGUACAUUACCUGGUA | CUUACCG GCU CUCUAUGA |
| 1389 | AAAUAGCG AGAA GAUUUC ACCAGAGAAACACACGUUGUGGUACAUUACCUGGUA | GAAAUCU GCU CGCUAUUU |
| 1535 | UUUCGUAA AGAA GGGGUU ACCAGAGAAACACACGUUGUGGUACAUUACCUGGUA | AACCCCA GAU UUACGAAA |
| 1566 | AGAGCCGG AGAA GGAAAC ACCAGAGAAACACACGUUGUGGUACAUUACCUGGUA | GUUUCCA GAC CCGGCUCU |
| 1572 | GGGUAGAG AGAA GGGUCU ACCAGAGAAACACACGUUGUGGUACAUUACCUGGUA | AGACCCG GCU CUCUACCC |

TABLE III-continued

Human fLt1 VEGF Receptor-Hairpin Ribozyme and Substrate sequence

| nt. Position | HP Ribozyme Sequence | Substrate |
|---|---|---|
| 1604 | CGGUACAA AGAA GGAUUU ACCAGAGAAACACACGUUGUGGUACAUUACCUGGUA | AAAUCCU GAC UUGUACCG |
| 1824 | AUUCUAGA AGAA GCCACA ACCAGAGAAACACACGUUGUGGUACAUUACCUGGUA | UGUGGCU GAC UCUAGAAU |
| 1908 | UUUGGCAC AGAA GUGAUA ACCAGAGAAACACACGUUGUGGUACAUUACCUGGUA | UAUCACA GAU GUGCCAAA |
| 1949 | CUCCUUCC AGAA GCAUUU ACCAGAGAAACACACGUUGUGGUACAUUACCUGGUA | AAAUGCC GAC GGAAGGAG |
| 1973 | CUGUGCAA AGAA GUUUCA ACCAGAGAAACACACGUUGUGGUACAUUACCUGGUA | UGAAACU GUC UUGCACAG |
| 2275 | AGUGGUGG AGAA GCUGAU ACCAGAGAAACACACGUUGUGGUACAUUACCUGGUA | AUCAGCA GUU CCACCACU |
| 2321 | ACCAAGUG AGAA GAGGCU ACCAGAGAAACACACGUUGUGGUACAUUACCUGGUA | AGCCUCA GAU CACUUGGU |
| 2396 | UUUCAAUA AGAA GCGUGC ACCAGAGAAACACACGUUGUGGUACAUUACCUGGUA | GCACGCU GUU UAUUGAAA |
| 2490 | GUUCCUUG AGAA GUGAGG ACCAGAGAAACACACGUUGUGGUACAUUACCUGGUA | CCUCACU GUU CAAGGAAC |
| 2525 | UUAGAGUG AGAA GCUCCA ACCAGAGAAACACACGUUGUGGUACAUUACCUGGUA | UGGAGCU GAU CACUCUAA |
| 2625 | GAUAGGUA AGAA GUCUUU ACCAGAGAAACACACGUUGUGGUACAUUACCUGGUA | AAAGACU GAC UACCUAUC |
| 2652 | GGAACUUC AGAA GGGUCC ACCAGAGAAACACACGUUGUGGUACAUUACCUGGUA | GGACCCA GAU GAAGUUCC |
| 2684 | CAUAAGGG AGAA GCUCAC ACCAGAGAAACACACGUUGUGGUACAUUACCUGGUA | GUGAGCG GCU CCCUUAUG |
| 2816 | CAGCCACA AGAA GGCACG ACCAGAGAAACACACGUUGUGGUACAUUACCUGGUA | CGUGCCG GAC UGUGGCUG |
| 2873 | GCUCAGUC AGAA GAGCUU ACCAGAGAAACACACGUUGUGGUACAUUACCUGGUA | AAGCUCU GAC GACUGAGC |
| 2930 | AGGCUCCC AGAA GGUUAA ACCAGAGAAACACACGUUGUGGUACAUUACCUGGUA | UUAACCU GCU GGGAGCCU |
| 2963 | CAAUCACC AGAA GAGGCC ACCAGAGAAACACACGUUGUGGUACAUUACCUGGUA | GGCCUCU GAU GGUGAUUG |
| 3157 | UUCCUGAA AGAA GGAGCU ACCAGAGAAACACACGUUGUGGUACAUUACCUGGUA | AGCUCCG GCU UUCAGGAA |
| 3207 | UAGAAACC AGAA GAAUCC ACCAGAGAAACACACGUUGUGGUACAUUACCUGGUA | GGAUUCU GAC GGUUUCUA |
| 3211 | CUUGUAGA AGAA GUCAGA ACCAGAGAAACACACGUUGUGGUACAUUACCUGGUA | UCUGACG GUU UCUACAAG |
| 3245 | UGUAAGAA AGAA GAUCUU ACCAGAGAAACACACGUUGUGGUACAUUACCUGGUA | AAGAUCU GAU UUCUUACA |
| 3256 | CACUUGAA AGAA GUAAGA ACCAGAGAAACACACGUUGUGGUACAUUACCUGGUA | UCUUACA GUU UUCAAGUG |
| 3287 | UUCUGGAA AGAA GCAACU ACCAGAGAAACACACGUUGUGGUACAUUACCUGGUA | AGUUCCU GUC UUCCAGAA |
| 3402 | CUCACAUA AGAA GGGUUC ACCAGAGAAACACACGUUGUGGUACAUUACCUGGUA | GAACCCC GAU UAUGUGAG |
| 3580 | CCUCAGGC AGAA GCAAAA ACCAGAGAAACACACGUUGUGGUACAUUACCUGGUA | UUUUGCA GUC GCCUGAGG |
| 3641 | CCAGCAUG AGAA GAUAGA ACCAGAGAAACACACGUUGUGGUACAUUACCUGGUA | UCUAUCA GAU CAUGCUGG |
| 3655 | UCUGUGCC AGAA GUCCAG ACCAGAGAAACACACGUUGUGGUACAUUACCUGGUA | CUGGACU GCU GGCACAGA |
| 3810 | UCAGAGAA AGAA GGAGUU ACCAGAGAAACACACGUUGUGGUACAUUACCUGGUA | AACUCCU GCC UUCUCUGA |
| 3846 | AACUUCGG AGAA GAAAUA ACCAGAGAAACACACGUUGUGGUACAUUACCUGGUA | UAUUUCA GCU CGGAAGUU |
| 3873 | CUGACAUC AGAA GAGCUU ACCAGAGAAACACACGUUGUGGUACAUUACCUGGUA | AAGCUCU GAU GAUGUCAG |
| 3995 | GAGAGGCC AGAA GAGUGC ACCAGAGAAACACACGUUGUGGUACAUUACCUGGUA | GCACUCU GUU GGCCUCUC |
| 4100 | UGACAUCA AGAA GCCCCG ACCAGAGAAACACACGUUGUGGUACAUUACCUGGUA | CGGGGCU GUC UGAUGUCA |
| 4104 | CUGCUGAC AGAA GACAGC ACCAGAGAAACACACGUUGUGGUACAUUACCUGGUA | GCUGUCU GAU GUCAGCAG |
| 4120 | AUGGCAGA AGAA GGGCCU ACCAGAGAAACACACGUUGUGGUACAUUACCUGGUA | AGGCCCA GUU UCUGCCAU |
| 4135 | GUGCCCAC AGAA GGAAUG ACCAGAGAAACACACGUUGUGGUACAUUACCUGGUA | CAUUCCA GCU GUGGGCAC |
| 4210 | GGGCGGGG AGAA GCACGC ACCAGAGAAACACACGUUGUGGUACAUUACCUGGUA | GCGUGCU GCU CCCCGCCC |
| 4217 | AGUCUGGG AGAA GGGAGC ACCAGAGAAACACACGUUGUGGUACAUUACCUGGUA | GCUCCCC GCC CCCAGACU |

TABLE III-continued

Human fLt1 VEGF Receptor-Hairpin Ribozyme and Substrate sequence

| nt. Position | HP Ribozyme Sequence | Substrate |
|---|---|---|
| 4224 | GAGUUGUA AGAA GGGGGC ACCAGAGAAACACACGUUGUGGUACAUUACCUGGUA | GCCCCCA GAC UACAACUC |
| 4382 | CAAAAAGC AGAA GGCUCC ACCAGAGAAACACACGUUGUGGUACAUUACCUGGUA | GGAGCCA GCU GCUUUUUG |
| 4385 | UCACAAAA AGAA GCUGGC ACCAGAGAAACACACGUUGUGGUACAUUACCUGGUA | GCCAGCU GCU UUUUGUGA |
| 4537 | GGGGUUGG AGAA GGGAAG ACCAGAGAAACACACGUUGUGGUACAUUACCUGGUA | CUUCCCU GCU CCAACCCC |
| 4573 | CUCAAUCA AGAA GGUCCU ACCAGAGAAACACACGUUGUGGUACAUUACCUGGUA | AGGACCA GUU UGAUUGAG |
| 4594 | AUUGGGUG AGAA GUGCAG ACCAGAGAAACACACGUUGUGGUACAUUACCUGGUA | CUGCACU GAU CACCCAAU |
| 4628 | GGCUGCAG AGAA GGCCCA ACCAGAGAAACACACGUUGUGGUACAUUACCUGGUA | UGGGCCA GCC CUGCAGCC |
| 4636 | GGGUUUUG AGAA GCAGGG ACCAGAGAAACACACGUUGUGGUACAUUACCUGGUA | CCCUGCA GCC CAAAACCC |
| 4866 | AGGGUCAG AGAA GGGAAG ACCAGAGAAACACACGUUGUGGUACAUUACCUGGUA | CUUCCCA GCU CUGACCCU |
| 4871 | GUAGAAGG AGAA GAGCUG ACCAGAGAAACACACGUUGUGGUACAUUACCUGGUA | CAGCUCU GAC CCUUCUAC |
| 4905 | CGCUGUCC AGAA GCUCCU ACCAGAGAAACACACGUUGUGGUACAUUACCUGGUA | AGGAGCA GAU GGACAGCG |
| 5233 | CUGUGCAA AGAA GAAUAA ACCAGAGAAACACACGUUGUGGUACAUUACCUGGUA | UUAUUCU GUU UUGCACAG |
| 5281 | CUCCUCAG AGAA GCAUUU ACCAGAGAAACACACGUUGUGGUACAUUACCUGGUA | AAAUGCA GUC CUGAGGAG |
| 5319 | UUUCCUCC AGAA GCCCUC ACCAGAGAAACACACGUUGUGGUACAUUACCUGGUA | GAGGGCU GAU GGAGGAAA |
| 5358 | GGUAUAGA AGAA GGGUCU ACCAGAGAAACACACGUUGUGGUACAUUACCUGGUA | AGACCCC GUC UCUAUACC |
| 5392 | UGGGUCCC AGAA GUGUUG ACCAGAGAAACACACGUUGUGGUACAUUACCUGGUA | CAACACA GUU GGGACCCA |
| 5563 | UGAGUCCC AGAA GGAGAA ACCAGAGAAACACACGUUGUGGUACAUUACCUGGUA | UUCUCCA GUU GGGACUCA |
| 5622 | AGUUUCAA AGAA GUUGAA ACCAGAGAAACACACGUUGUGGUACAUUACCUGGUA | UUCAACU GCU UUGAAACU |
| 5738 | UAGCAUCA AGAA GAGCCA ACCAGAGAAACACACGUUGUGGUACAUUACCUGGUA | UGGCUCU GUU UGAUGCUA |
| 5838 | UAGCAUCA AGAA GAGCCA ACCAGAGAAACACACGUUGUGGUACAUUACCUGGUA | UGGGUCU GUU UGAUGCUA |
| 5933 | CCCCAAGA AGAA GCAAUC ACCAGAGAAACACACGUUGUGGUACAUUACCUGGUA | GAUUGCU GCU UCUUGGGG |
| 6022 | CACAUAAG AGAA GAGGCA ACCAGAGAAACACACGUUGUGGUACAUUACCUGGUA | UGCCUCU GUU CUUAUGUG |
| 6120 | UCCACAAA AGAA GCUGCC ACCAGAGAAACACACGUUGUGGUACAUUACCUGGUA | GGCAGCG GCU UUUGUGGA |
| 6163 | GUGGAGAG AGAA GUCCCA ACCAGAGAAACACACGUUGUGGUACAUUACCUGGUA | UGGGACA GUC CUCUCCAC |
| 6270 | AAAUUGCC AGAA GUCACA ACCAGAGAAACACACGUUGUGGUACAUUACCUGGUA | UGUGACA GCU GGCAAUUU |
| 6412 | AAGACAUG AGAA GCUAAG ACCAGAGAAACACACGUUGUGGUACAUUACCUGGUA | CUUAGCU GUU CAUGUCUU |
| 6511 | UUUGAAGG AGAA GAGUAA ACCAGAGAAACACACGUUGUGGUACAUUACCUGGUA | UUACUCA GCU CCUUCAAA |
| 6778 | UCCACCCA AGAA GUUCCA ACCAGAGAAACACACGUUGUGGUACAUUACCUGGUA | UGGAACA GUC UGGGUGGA |
| 6826 | ACUUCUUG AGAA GACAAG ACCAGAGAAACACACGUUGUGGUACAUUACCUGGUA | CUUGUCA GUC CAAGAAGU |
| 7245 | AACAUAAA AGAA GUUGCC ACCAGAGAAACACACGUUGUGGUACAUUACCUGGUA | GGCAACU GCU UUUAUGUU |
| 7258 | UGGAAGGA AGAA GAACAU ACCAGAGAAACACACGUUGUGGUACAUUACCUGGUA | AUGUUCU GUC UCCUUCCA |
| 7433 | CCCAUACA AGAA GCUAAA ACCAGAGAAACACACGUUGUGGUACAUUACCUGGUA | UUUAGCU GAU UGUAUGGG |
| 7512 | UUUUCAUG AGAA GGAAUU ACCAGAGAAACACACGUUGUGGUACAUUACCUGGUA | AAUUCCU GUC CAUGAAAA |
| 7606 | GACAUUCA AGAA GAAAUG ACCAGAGAAACACACGUUGUGGUACAUUACCUGGUA | CAUUUCA GCC UGAAUGUC |
| 7618 | AAUAUAUA AGAA GACAUU ACCAGAGAAACACACGUUGUGGUACAUUACCUGGUA | AAUGUCU GCC UAUAUAUU |
| 7633 | AUACAAAG AGAA GAGAAU ACCAGAGAAACACACGUUGUGGUACAUUACCUGGUA | AUUCUCU GCU CUUUGUAU |

Table IV

Human KDR VEGF Receptor-Hammerhead Ribozyme and Substrate Sequence

| nt. Position | HH Ribozyme Sequence | Substrate |
|---|---|---|
| 21 | CACAGGGC CUGAUGA X GAA ACGGCCAG | CUGGCCGUC GCCCUGUG |
| 33 | UCCACGCA CUGAUGA X GAA AGCCACAG | CUGUGGCUC UGCGUGGA |
| 56 | AACCCACA CUGAUGA X GAA AGGCGGCC | GGCCGCCUC UGUGGGUU |
| 64 | ACUAGGCA CUGAUGA X GAA ACCCACAG | CUGUGGGUU UGCCUAGU |
| 65 | CACUAGGC CUGAUGA X GAA AACCCACA | UGUGGGUUU GCCUAGUG |
| 70 | AGAAACAC CUGAUGA X GAA AGGCAAAC | GUUUGCCUA GUGUUUCU |
| 75 | UCAAGAGA CUGAUGA X GAA ACACUAGG | CCUAGUGUU UCUCUUGA |
| 76 | AUCAAGAG CUGAUGA X GAA AACACUAG | CUAGUGUUU CUCUUGAU |
| 77 | GAUCAAGA CUGAUGA X GAA AAACACUA | UAGUGUUUC UCUUGAUC |
| 79 | CAGAUCAA CUGAUGA X GAA AGAAACAC | GUGUUUCUC UUGAUCUG |
| 81 | GGCAGAUC CUGAUGA X GAA AGAGAAAC | GUUUCUCUU GAUCUGCC |
| 85 | CCUGGGGA CUGAUGA X GAA AUCAAGAG | CUCUUGAUC UGCCCAGG |
| 96 | UGUAUGCU CUGAUGA X GAA AGCCUGGG | CCCAGGCUC AGCAUACA |
| 102 | UCUUUUUG CUGAUGA X GAA AUGCUGAG | CUCAGCAUA CAAAAAGA |
| 114 | AUUGUAAG CUGAUGA X GAA AUGUCUUU | AAAGACAUA CUUACAAU |
| 117 | UUAAUUGU CUGAUGA X GAA AGUAUGUC | GACAUACUU ACAAUUAA |
| 118 | CUUAAUUG CUGAUGA X GAA AAGUAUGU | ACAUACUUA CAAUUAAG |
| 123 | UUAGCCUU CUGAUGA X GAA AUUGUAAG | CUUACAAUU AAGGCUAA |
| 124 | AUUAGCCU CUGAUGA X GAA AAUUGUAA | UUACAAUUA AGGCUAAU |
| 130 | AGUUGUAU CUGAUGA X GAA AGCCUUAA | UUAAGGCUA AUACAACU |
| 133 | AAGAGUUG CUGAUGA X GAA AUUAGCCU | AGGCUAAUA CAACUCUU |
| 139 | AAUUUGAA CUGAUGA X GAA AGUUGUAU | AUACAACUC UUCAAAUU |
| 141 | GUAAUUUG CUGAUGA X GAA AGAGUUGU | ACAACUCUU CAAAUUAC |
| 142 | AGUAAUUU CUGAUGA X GAA AAGAGUUG | CAACUCUUC AAAUUACU |
| 147 | CUGCAAGU CUGAUGA X GAA AUUUGAAG | CUUCAAAUU ACUUGCAG |
| 148 | CCUGCAAG CUGAUGA X GAA AAUUUGAA | UUCAAAUUA CUUGGAGG |
| 151 | UCCCCUGC CUGAUGA X GAA AGUAAUUU | AAAUUACUU GCAGGGGA |
| 170 | GCCAGUCC CUGAUGA X GAA AGUCCCUC | GAGGGACUU GGACUGGC |
| 180 | UUGGGCCA CUGAUGA X GAA AGCCAGUC | GACUGGCUU UGGCCCAA |
| 181 | AUUGGGCC CUGAUGA X GAA AAGCCAGU | ACUGGcUUU GGCCCAAU |
| 190 | ACUCUGAU CUGAUGA X GAA AUUGGGCC | GGCCCAAUA AUCAAAGU |
| 193 | GCCACUCU CUGAUGA X GAA AUUAUUGG | CCAAUAAUC AGAGUGGC |
| 243 | UUACAGAA CUGAUGA X GAA AGGCCAUC | GAUGGCCUC UUCUGUAA |
| 245 | UCUUACAG CUGAUGA X GAA ACAGGCCA | UGGCCUCUU CUGUAAGA |
| 246 | GUCUUACA CUGAUGA X GAA AAGAGGCC | GGCCUCUUC UGUAAGAC |
| 250 | GAGUGUCU CUGAUGA X GAA ACAGAAGA | UCUUCUGUA AGACACUC |
| 258 | GGAAUUGU CUGAUGA X GAA AGUGUCUU | AAGACACUC ACAAUUCC |

Table IV-continued

Human KDR VEGF Receptor-Hammerhead Ribozyme and Substrate Sequence

| nt. Position | HH Ribozyme Sequence | Substrate |
|---|---|---|
| 264 | ACUUUUGG CUGAUGA X GAA AUUGUGAG | CUCACAAUU CCAAAAGU |
| 265 | CACUUUUG CUGAUGA X GAA AAUUGUGA | UCACAAUUC CAAAAGUG |
| 276 | UCAUUUCC CUGAUGA X GAA AUCACUUU | AAAGUGAUC GGAAAUGA |
| 296 | AGCACUUG CUGAUGA X GAA AGGCUCCA | UGGAGCCUA CAAGUGCU |
| 305 | CCCGGUAG CUGAUGA X GAA AGCACUUG | CAAGUGCUU CUACCGGG |
| 306 | UCCCGGUA CUGAUGA X GAA AAGCACUU | AAGUGCUUC UACCGGGA |
| 308 | UUUCCCGG CUGAUGA X GAA AGAAGCAC | GUGCUUCUA CCGGGAAA |
| 323 | CCGAGGCC CUGAUGA X GAA AGUCAGUU | AACUGACUU GGCCUCGG |
| 329 | AAAUGACC CUGAUGA X GAA AGGCCAAG | CUUGGCCUC GGUCAUUU |
| 333 | ACAUAAAU CUGAUGA X GAA ACCGAGGC | GCCUCGGUC AUUUAUGU |
| 336 | UAGACAUA CUGAUGA X GAA AUGACCGA | UCGGUCAUU UAUGUCUA |
| 337 | AUAGACAU CUGAUGA X GAA AAUGACCG | CGGUCAUUU AUGUCUAU |
| 338 | CAUAGACA CUGAUGA X GAA AAAUGACC | GGUCAUUUA UGUCUAUG |
| 342 | UGAACAUA CUGAUGA X GAA ACAUAAAU | AUUUAUGUC UAUGUUCA |
| 344 | CUUGAACA CUGAUGA X CAA AGACAUAA | UUAUGUCUA UGUUCAAG |
| 348 | UAAUCUUG CUGAUGA X GAA ACAUAGAC | GUCUAUGUU CAAGAUUA |
| 349 | GUAAUCUU CUGAUGA X GAA AACAUAGA | UCUAUGUUC AAGAUUAC |
| 355 | AGAUCUGU CUGAUGA X GAA AUCUUGAA | UUCAAGAUU ACAGAUCU |
| 356 | GAGAUCUG CUGAUGA X GAA AAUCUUGA | UCAAGAUUA CAGAUCUC |
| 362 | UAAAUGGA CUGAUGA X GAA AUCUGUAA | UUACAGAUC UCCAUUUA |
| 364 | AAUAAAUG CUGAUGA X GAA AGAUCUGU | ACAGAUCUC CAUUUAUU |
| 368 | AAGCAAUA CUGAUGA X GAA AUGGAGAU | AUCUCCAUU UAUUGCUU |
| 369 | GAAGCAAU CUGAUGA X GAA AAUGGAGA | UCUCCAUUU AUUGCUUC |
| 370 | AGAAGCAA CUGAUGA X GAA AAAUGGAG | CUCCAUUUA UUGCUUCU |
| 372 | ACAGAAGC CUGAUGA X GAA AUAAAUGG | CCAUUUAUU GCUUCUGU |
| 376 | ACUAACAG CUGAUGA X GAA AGCAAUAA | UUAUUGCUU CUGUUAGU |
| 377 | CACUAACA CUGAUGA X GAA AAGCAAUA | UAUUGCUUC UGUUAGUG |
| 381 | UGGUCACU CUGAUGA X GAA ACAGAAGC | GCUUCUGUU AGUGACCA |
| 382 | UUGGUCAC CUGAUGA X GAA AACAGAAG | CUUCUGUUA GUGACCAA |
| 399 | AUGUACAC CUGAUGA X GAA ACUCCAUG | CAUGGAGUC GUGUACAU |
| 404 | CAGUAAUG CUGAUGA X GAA ACACGACU | AGUCGUGUA CAUUACUG |
| 408 | UUCUCAGU CUGAUGA X GAA AUGUACAC | GUGUACAUU ACUGAGAA |
| 409 | GUUCUCAG CUGAUGA X GAA AAUGUACA | UGUACAUUA CUGAGAAC |
| 438 | AGACAUGG CUGAUGA X GAA AUCACCAC | GUGGUGAUU CCAUGUCU |
| 439 | GAGACAUG CUGAUGA X GAA AAUCACCA | UGGUGAUUC CAUGUCUC |
| 445 | GGACCCGA CUGAUGA X GAA ACAUGGAA | UUCCAUGUC UCGGGUCC |

Table IV-continued

Human KDR VEGF Receptor-Hammerhead Ribozyme and Substrate Sequence

| nt. Position | HH Ribozyme Sequence | Substrate |
|---|---|---|
| 447 | AUGGACCC CUGAUGA X GAA AGACAUGG | CCAUGUCUC GGGUCCAU |
| 452 | UUGAAAUG CUGAUGA X GAA ACCCGAGA | UCUCGGGUC CAUUUCAA |
| 456 | AGAUUUGA CUGAUGA X GAA AUGGACCC | GGGUCCAUU UCAAAUCU |
| 457 | GAGAUUUG CUGAUGA X GAA AAUGGACC | GGUCCAUUU CAAAUCUC |
| 458 | UGAGAUUU CUGAUGA X GAA AAAUGGAC | GUCCAUUUC AAAUCUCA |
| 463 | CACGUUGA CUGAUGA X GAA AUUUGAAA | UUUCAAAUC UCAACGUG |
| 465 | GACACGUU CUGAUGA X GAA AGAUUUGA | UCAAAUCUC AACGUGUC |
| 473 | CACAAAGU CUGAUGA X GAA ACACGUUG | CAACGUGUC ACUUUGUG |
| 477 | CUUGCACA CUGAUGA X GAA AGUGACAC | GUGUCACUU UGUGCAAG |
| 478 | UCUUGCAC CUGAUGA X GAA AAGUGACA | UGUCACUUU GUGCAAGA |
| 488 | UUUCUGGG CUGAUGA X GAA AUCUUGCA | UGCAAGAUA CCCAGAAA |
| 503 | CAGGAACA CUGAUGA X GAA AUCUCUUU | AAAGAGAUU UGUUCCUG |
| 504 | UCAGGAAC CUGAUGA X GAA AAUCUCUU | AAGAGAUUU GUUCCUGA |
| 507 | CCAUCAGG CUGAUGA X GAA ACAAAUCU | AGAUUUGUU CCUGAUGG |
| 508 | ACCAUCAG CUGAUGA X GAA AACAAAUC | GAUUUGUUC CUGAUGGU |
| 517 | AAUUCUGU CUGAUGA X GAA ACCAUCAG | CUGAUGGUA ACAGAAUU |
| 525 | UCCCAGGA CUGAUGA X GAA AUUCUGUU | AACAGAAUU UCCUGGGA |
| 526 | GUCCCAGG CUGAUGA X GAA AAUUCUGU | ACAGAAUUU CGGGGAC |
| 527 | UGUCCCAG CUGAUGA X GAA AAAUUCUG | CAGAAUUUC CUGGGACA |
| 548 | GAAAAGUA CUGAUGA X GAA AGCCCUUC | GAAGGGCUU UACUAUUC |
| 549 | GGAAUAGU CUGAUGA X GAA AAGCCCUU | AAGGGCUUU ACUAUUCC |
| 550 | GCGAAUAG CUGAUGA X GAA AAAGCCCU | AGGGCUUUA CUAUUCCC |
| 553 | GCUGGGAA CUGAUGA X GAA AGUAAAGC | GCUUUACUA UUCCCAGC |
| 555 | UAGCUGGG CUGAUGA X GAA AUAGUAAA | UUUACUAUU CCCAGCUA |
| 556 | GUAGCUGG CUGAUGA X GAA AAUAGUAA | UUACUAUUC CCAGCUAC |
| 563 | UGAUCAUG CUGAUGA X GAA AGCUGGGA | UCCCAGCUA CAUGAUCA |
| 570 | GCAUAGCU CUGAUGA X GAA AUCAUGUA | UACAUGAUC AGCUAUGC |
| 575 | UGCCAGCA CUGAUGA X GAA AGCUGAUC | GAUCAGCUA UGCUGGCA |
| 588 | UCACAGAA CUGAUGA X GAA ACCAUGCC | GCCAUGGUC UUCUGUGA |
| 590 | CUUCACAG CUGAUGA X GAA AGACCAUG | CAUGGUCUU CUGUGAAG |
| 591 | GCUUCACA CUGAUGA X GAA AAGACCAU | AUGGUCUUC UGUGAAGC |
| 606 | UCAUCAUU CUGAUGA X GAA AUUUUUGC | GCAAAAAUU AAUGAUGA |
| 607 | UUCAUCAU CUGAUGA X GAA AAUUUUUG | CAAAAAUUA AUGAUGAA |
| 619 | AGACUGGU CUGAUGA X GAA ACUUUCAU | AUGAAAGUU ACCAGUCU |
| 620 | UAGACUGG CUGAUGA X GAA AACUUUCA | UGAAAGUUA CCAGUCUA |
| 626 | ACAUAAUA CUGAUGA X GAA ACUGGUAA | UUACCAGUC UAUUAUGU |
| 628 | GUACAUAA CUGAUGA X GAA AGACUGGU | ACCAGUCUA UUAUGUAC |

Table IV-continued

Human KDR VEGF Receptor-Hammerhead Ribozyme and Substrate Sequence

| nt. Position | HH Ribozyme Sequence | Substrate |
|---|---|---|
| 630 | AUGUACAU CUGAUGA X GAA AUAGACUG | CAGUCUAUU AUGUACAU |
| 631 | UAUGUACA CUGAUGA X GAA AAUAGACU | AGUCUAUUA UGUACAUA |
| 635 | CAACUAUG CUGAUGA X GAA ACAUAAUA | UAUUAUGUA CAUAGUUG |
| 639 | ACGACAAC CUGAUGA X GAA AUGUACAU | AUGUACAUA GUUGUCGU |
| 642 | ACAACGAC CUGAUGA X GAA ACUAUGUA | UACAUAGUU GUCGUUGU |
| 645 | CCUACAAC CUGAUGA X GAA ACAACUAU | AUAGUUGUC GUUGUAGG |
| 648 | UACCCUAC CUGAUGA X GAA ACGACAAC | GUUGUCGUU GUAGGGUA |
| 651 | CUAUACCC CUGAUGA X GAA ACAACGAC | GUCGUUGUA GGGUAUAG |
| 656 | AAAUCCUA CUGAUGA X GAA ACCCUACA | UGUAGGGUA UAGGAUUU |
| 658 | AUAAAUCC CUGAUGA X GAA AUACCCUA | UAGGGUAUA GGAUUUAU |
| 663 | ACAUCAUA CUGAUGA X GAA AUCCUAUA | UAUAGGAUU UAUGAUGU |
| 664 | CACAUCAU CUGAUGA X GAA AAUCCUAU | AUAGGAUUU AUGAUGUG |
| 665 | CCACAUCA CUGAUGA X GAA AAAUCCUA | UAGGAUUUA UGAUGUGG |
| 675 | GGACUCAG CUGAUGA X GAA ACCACAUC | GAUGUGGUU CUGAGUCC |
| 676 | CGGACUCA CUGAUGA X GAA AACCACAU | AUGUGGUUC UGAGUCCG |
| 682 | AUGAGACG CUGAUGA X GAA ACUCAGAA | UUCUGAGUC CGUCUCAU |
| 686 | UUCCAUGA CUGAUGA X GAA ACGGACUC | GAGUCCGUC UCAUGGAA |
| 688 | AAUUCCAU CUGAUGA X GAA AGACGGAC | GUCCGUCUC AUGGAAUU |
| 696 | GAUAGUUC CUGAUGA X GAA AUUCCAUG | CAUGGAAUU GAACUAUC |
| 702 | CCAACAGA CUGAUGA X GAA AGUUCAAU | AUUGAACUA UCUGUUGG |
| 704 | CUCCAACA CUGAUGA X GAA AUAGUUCA | UGAACUAUC UGUUGGAG |
| 708 | UUUUCUCC CUGAUGA X GAA ACAGAUAG | CUAUCUGUU GGAGAAAA |
| 720 | UUUAAGAC CUGAUGA X GAA AGCUUUUC | GAAAAGCUU GUCUUAAA |
| 723 | CAAUUUAA CUGAUGA X GAA ACAAGCUU | AAGCUUGUC UUAAAUUG |
| 725 | UACAAUUU CUGAUGA X GAA AGACAAGC | GCUUGUCUU AAAUUGUA |
| 726 | GUACAAUU CUGAUGA X GAA AAGACAAG | CUUGUCUUA AAUUGUAC |
| 730 | UGCUGUAC CUGAUGA X GAA AUUUAAGA | UCUUAAAUU GUACAGCA |
| 733 | UCUUGCUG CUGAUGA X GAA ACAAUUUA | UAAAUUGUA CAGCAAGA |
| 750 | CCCACAUU CUGAUGA X GAA AGUUCAGU | ACUGAACUA AAUGUGGG |
| 762 | UUGAAGUC CUGAUGA X GAA AUCCCCAC | GUGGGGAUU GACUUCAA |
| 767 | CCCAGUUG CUGAUGA X GAA AGUGAAUC | GAUUGACUU CAACUGGG |
| 768 | UCCCAGUU CUGAUGA X GAA AAGUCAAU | AUUGACUUC AACUGGGA |
| 779 | AAGAAGGG CUGAUGA X GAA AUUCCCAG | CUGGGAAUA CCCUUCUU |
| 784 | CUUCGGAG CUGAUGA X GAA AGGGUAUU | AAUACCCUU CUUCGGAG |
| 785 | GCUUCGAA CUGAUGA X GAA AAGGGUAU | AUACCCUUC UUCGAAGC |
| 787 | AUGCUUCG CUGAUGA X GAA AGAAGGGU | ACCCUUCUU CGAAGCAU |

Table IV-continued

Human KDR VEGF Receptor-Hammerhead Ribozyme and Substrate Sequence

| nt. Position | HH Ribozyme Sequence | Substrate |
|---|---|---|
| 788 | GAUGCUUC CUGAUGA X GAA AAGAAGGG | CCCUUCUUC GAAGCAUC |
| 796 | CUUAUGCU CUGAUGA X GAA AUGCUUCG | CGAAGCAUC AGCAUAAG |
| 802 | AAGUUUCU CUGAUGA X GAA AUGCUGAU | AUCAGCAUA AGAAACUU |
| 810 | CGGUUUAC CUGAUGA X GAA AGUUUCUU | AAGAAACUU GUAAACCG |
| 813 | UCUCGGUU CUGAUGA X GAA ACAAGUUU | AAACUUGUA AACCGAGA |
| 825 | UGGGUUUU CUGAUGA X GAA AGGUCUCG | GGAGACCUA AAAACCCA |
| 836 | CACUCCCA CUGAUGA X GAA ACUGGGUU | AACCCAGUC UGGGAGUG |
| 857 | UGCUCAAA CUGAUGA X GAA AUUUCUUC | GAAGAAAUU UUUGAGCA |
| 858 | GUGCUCAA CUGAUGA X GAA AAUUUCUU | AAGAAAUUU UUGAGCAC |
| 859 | GGUGCUCA CUGAUGA X GAA AAAUUUCU | AGAAAUUUU UGAGCACC |
| 860 | AGGUGCUC CUGAUGA X GAA AAAAUUUC | GAAAUUUUU GAGCACCU |
| 869 | CUAUAGUU CUGAUGA X GAA AGGUGCUC | GAGCACCUU AACUAUAG |
| 870 | UCUAUAGU CUGAUGA X GAA AAGGUGCU | AGCACCUUA ACUAUAGA |
| 874 | ACCAUCUA CUGAUGA X GAA AGUUAAGG | CCUUAACUA UAGAUGGU |
| 876 | ACACCAUC CUGAUGA X GAA AUAGUUAA | UUAACUAUA GAUGGUGU |
| 885 | CUCCGGGU CUGAUGA X GAA ACACCAUC | GAUGGUGUA ACCCGGAG |
| 905 | AGGUGUAC CUGAUGA X GAA AUCCUUGG | CCAAGGAUU GUACACCU |
| 908 | CACAGGUG CUGAUGA X GAA ACAAUCCU | AGGAUUGUA CACCUGUG |
| 923 | GCCCACUG CUGAUGA X GAA AUGCUGCA | UGCAGCAUC CAGUGGGC |
| 956 | CCCUGACA CUGAUGA X GAA AUGUGCUG | CAGCACAUU UGUCAGGG |
| 957 | ACCCUGAC CUGAUGA X GAA AAUGUGCU | AGCACAUUU GUCAGGGU |
| 960 | UGGACCCU CUGAUGA X GAA ACAAAUGU | ACAUUUGUC AGGGUCCA |
| 966 | UUUUCAUG CUGAUGA X GAA ACCCUGAC | GUCAGGGUC CAUGAAAA |
| 979 | AGCAACAA CUGAUGA X GAA AGGUUUUU | AAAAACCUU UUGUUGCU |
| 980 | AAGCAACA CUGAUGA X GAA AAGGUUUU | AAAACGUUU UGUUGCCU |
| 981 | AAAGCAAC CUGAUGA X GAA AAAGGUUU | AAACCUUUU GUUGCUUU |
| 984 | CCAAAAGC CUGAUGA X GAA ACAAAAGG | CCUUUUGUU GCUUUUGG |
| 988 | ACUUCCAA CUGAUGA X GAA AGCAACAA | UUGUUGCUU UUGGAAGU |
| 989 | CACUUCCA CUGAUGA X GAA AAGCAACA | UGUUGCUUU UGGAAGUG |
| 990 | CCACUUCC CUGAUGA X GAA AAAGCAAC | GUUGCUUUU GGAAGUGG |
| 1007 | CCACCAGA CUGAUGA X GAA AUUCCAUG | CAUGGAAUC UGUGGUGG |
| 1009 | UUCCACCA CUGAUGA X GAA AGAUUCCA | UGGAAUCUC UGGUGGAA |
| 1038 | GGGAUUCU CUGAUGA X GAA ACACGCUC | GAGCGUGUC AGAAUCCC |
| 1044 | UUCGCAGG CUGAUGA X GAA AUUCUGAC | GUCAGAAUC CUGCGAA |
| 1055 | AACCAAGG CUGAUGA X GAA ACUUCGCA | UGCAAGUA CCUUGGUU |
| 1059 | GGGUAACC CUGAUGA X GAA AGGUACUU | AAGUACCUU GGUUACCC |
| 1063 | GGGUGGGU CUGAUGA X GAA ACCAAGGU | ACCUUGGUU ACCCACCC |

Table IV-continued

Human KDR VEGF Receptor-Hammerhead Ribozyme and Substrate Sequence

| nt. Position | HH Ribozyme Sequence | Substrate |
|---|---|---|
| 1064 | GGGGUGGG CUGAUGA X GAA AACCAAGG | CCUUGGUUA CCCACCCC |
| 1080 | UACCAUUU CUGAUGA X GAA AUUUCUGG | CCAGAAAUA AAAUGGUA |
| 1088 | CAUUUUUA CUGAUGA X GAA ACCAUUUU | AAAAUGGUA UAAAAAUG |
| 1090 | UCCAUUUU CUGAUGA X GAA AUACCAUU | AAUGGUAUA AAAAUGGA |
| 1101 | UCAAGGGG CUGAUGA X GAA AUUCCAUU | AAUGGAAUA CCCCUUGA |
| 1107 | UUGGACUC CUGAUGA X GAA AGGGGUAU | AUACCCCUU GAGUCCAA |
| 1112 | UGUGAUUG CUGAUGA X GAA ACUCAAGG | CCUUGAGUC CAAUCACA |
| 1117 | AAUUGUGU CUGAUGA X GAA AUUGGACU | AGUCCAAUC ACACAAUU |
| 1125 | CCCGCUUU CUGAUGA X GAA AUUGUGUG | CACACAAUU AAAGCGGG |
| 1126 | CCCGGCUU CUGAUGA X GAA AAUUGUGU | ACACAAUUA AAGCGGGG |
| 1140 | AUCGUCAG CUGAUGA X GAA ACAUGCCC | GGGCAUGUA CUGACGAU |
| 1149 | ACUUCCAU CUGAUGA X GAA AUCGUCAG | CUGACGAUU AUGGAAGU |
| 1150 | CACUUCCA CUGAUGA X GAA AAUCGUCA | UGACGAUUA UGGAAGUG |
| 1180 | GACAGUGU CUGAUGA X GAA AUUUCCUG | CAGGAAAUU ACACUGUC |
| 1181 | UGACAGUG CUGAUGA X GAA AAUUUCCU | AGGAAAUUA CACUGUCA |
| 1188 | GUAAGGAU CUGAUGA X GAA ACAGUGUA | UACACUGUC AUCCUUAC |
| 1191 | UUGGUAAG CUGAUGA X GAA AUGACAGU | ACUGUCAUC CUUACCAA |
| 1194 | GGAUUGGU CUGAUGA X GAA AGGAUGAC | GUCAUCCUU ACCAAUCC |
| 1195 | GGGAUUGG CUGAUGA X GAA AAGGAUGA | UCAUCCUUA CCAAUCCC |
| 1201 | UGAAAUGG CUGAUGA X GAA AUUGGUAA | UUACCAAUC CAUUUCA |
| 1206 | UCCUUUGA CUGAUGA X GAA AUGGGAUU | AAUCCCAUU UCAAGGA |
| 1207 | CUCGUUUG CUGAUGA X GAA AAUGGGAU | AUCCCAUUU CAAAGGAG |
| 1208 | UCUCCUUU CUGAUGA X GAA AAAUGGGA | UCCCAUUUC AAAGGAGA |
| 1233 | ACCAGAGA CUGAUGA X GAA ACCACAUG | CAUGUGGUC UCUCUGGU |
| 1235 | CAACCAGA CUGAUGA X GAA AGACCACA | UGUGGUCUC UCUGGUUG |
| 1237 | CACAACCA CUGAUGA X GAA AGAGACCA | UGGUCUCUC UGGUUGUG |
| 1242 | ACAUACAC CUGAUGA X GAA ACCAGAGA | UCUCUGGUU GUGUAUGU |
| 1247 | GUGGGACA CUGAUGA X GAA ACACAACC | GGUUGUGUA UGUCCCAC |
| 1251 | UGGGGUGG CUGAUGA X GAA ACAUACAC | GUGUAUGUC CACCCCA |
| 1263 | UUCUCACC CUGAUGA X GAA AUCUGGGG | CCCCAGAUU GGUGACAA |
| 1274 | AGAUUAGA CUGAUGA X GAA AUUUCUCA | UGAGAAAUC UCUAAUCU |
| 1276 | AGAGAUUA CUGAUGA X GAA AGAUUUCU | AGAAAUCUC UAAUCUCU |
| 1278 | GGAGAGAU CUGAUGA X GAA AGAGAUUU | AAAUCUCUA AUCUCUCC |
| 1281 | ACAGGAGA CUGAUGA X GAA AUUAGAGA | UCUCUAAUC UCCUGU |
| 1283 | CCACAGGA CUGAUGA X GAA AGAUUAGA | UCUAAUCUC UCCUGUGG |
| 1285 | AUCCACAG CUGAUGA X GAA AGAGAUUA | UAAUCUCUC CUGUGGAU |

Table IV-continued

Human KDR VEGF Receptor-Hammerhead Ribozyme and Substrate Sequence

| nt. Position | HH Ribozyme Sequence | Substrate |
|---|---|---|
| 1294 | CUGGUAGG CUGAUGA X GAA AUCCACAG | CUGUGGAUU CCUACCAG |
| 1295 | ACUGGUAG CUGAUGA X GAA AAUCCACA | UGUGGAUUC CUACCAGU |
| 1298 | CGUACUGG CUGAUGA X GAA AGGAAUCC | GGAUUCCUA CCAGUACG |
| 1304 | UGGUGCCG CUGAUGA X GAA ACUGGUAG | CUACCAGUA CGCCACCA |
| 1315 | CAGCGUUU CUGAUGA X GAA AGUGGUGC | GCACCACUC AAACGCUG |
| 1330 | AUAGACCG CUGAUGA X GAA ACAUGUCA | UGACAUGUA CGGUCUAU |
| 1335 | AUGGCAUA CUGAUGA X GAA ACCGUACA | UGUACGGUC UAUGCCAU |
| 1337 | GAAUGGCA CUGAUGA X GAA AGACCGUA | UACGGUCUA UGCCAUUC |
| 1344 | GGGGGAGG CUGAUGA X GAA AUGGCAUA | UAUGCCAUU CCUCCCCC |
| 1345 | CGGGGGAG CUGAUGA X GAA AAUGGCAU | AUGCCAUUC CUCCCCCG |
| 1348 | AUGCGGGG CUGAUGA X GAA AGGAAUGG | CCAUUCCUC CCCCGCAU |
| 1357 | GUGGAUGU CUGAUGA X GAA AUGCGGGG | CCCCGCAUC ACAUCCAC |
| 1362 | UACCAGUG CUGAUGA X GAA AUGUGAUG | CAUCACAUC CACUGGUA |
| 1370 | ACUGCCAA CUGAUGA X GAA ACCAGUGG | CCACUGGUA UUGGCAGU |
| 1372 | CAACUGCC CUGAUGA X GAA AUACCAGU | ACUGGUAUU GCCAGUUG |
| 1379 | CUUCCUCC CUGAUGA X GAA ACUGCCAA | UUGGCAGUU GGAGGAAG |
| 1416 | GUCACUGA CUGAUGA X GAA ACAGCUUG | CAAGCUGUC UCAGUGAC |
| 1418 | UUGUCACU CUGAUGA X GAA AGACAGCU | AGCUGUCUC AGUGACAA |
| 1433 | CACAAGGG CUGAUGA X GAA AUGGGUUU | AAACCCAUA CCCUUGUG |
| 1438 | UUCUUCAC CUGAUGA X GAA AGGGUAUG | CAUACCCUU GUGAACAA |
| 1466 | CUCCCUGG CUGAUGA X GAA AGUCCUCC | GGAGGACUU CCAGGGAG |
| 1467 | CCUCCCUG CUGAUGA X GAA AAGUCCUC | GAGGACUUC CAGGGAGG |
| 1480 | UUCAAUUU CUGAUGA X GAA AUUUCCUC | GAGGAAAUA AAAUUGAA |
| 1485 | UUAACUUC CUGAUGA X GAA AUUUUAUU | AAUAAAAUU GAAGUUAA |
| 1491 | UUUUUAUU CUGAUGA X GAA ACUUCAAU | AUUGAAGUU AAUAAAAA |
| 1492 | AUUUUUAU CUGAUGA X GAA AAGUUCAA | UUGAAGUUA AUAAAAAU |
| 1495 | UGGAUUUU CUGAUGA X GAA AUUAACUU | AAGUUAAUA AAAAUCAA |
| 1501 | AGCAAAUU CUGAUGA X GAA AUUUUUAU | AUAAAAAUC AAUUUGCU |
| 1505 | UUAGAGCA CUGAUGA X GAA AUUGAUUU | AAAUCAAUU UGCUCUAA |
| 1506 | AUUAGAGC CUGAUGA X GAA AAUUGAUU | AAUCAAUUU GCUCUAAU |
| 1510 | UUCAAUUA CUGAUGA X GAA AGCAAAUU | AAUUUGCUC UAAUAGAA |
| 1512 | CCUUCAAU CUGAUGA X GAA AGAGCAAA | UUUGCUCUA AUUGAAGG |
| 1515 | UUUCCUUC CUGAUGA X GAA AUUAGAGC | GCUCUAAUU GAAGCAAA |
| 1536 | AGGGUACU CUGAUGA X GAA ACAGUUUU | AAAACUGUA AGUACCCU |
| 1540 | AACAAGGG CUGAUGA X GAA ACUUACAG | CUGUAAGUA CCCUUGUU |
| 1545 | UGGAUAAC CUGAUGA X GAA AGGGUACU | AGUACCCUU CUUAUCCA |
| 1548 | GCUUGGAU CUGAUGA X GAA ACAAGGGU | ACCCUUGUU AUCCAAGC |

Table IV-continued

Human KDR VEGF Receptor-Hammerhead Ribozyme and Substrate Sequence

| nt. Position | HH Ribozyme Sequence | Substrate |
|---|---|---|
| 1549 | CGCUUGGA CUGAUGA X GAA AACAAGGG | CCCUUGUUA UCCAAGCG |
| 1551 | GCCGCUUG CUGAUGA X GAA AUAACAAG | CUUGUUAUC CAAGCGGC |
| 1568 | ACAAAGCU CUGAUGA X GAA ACACAUUU | AAAUGUGUC AGCUUUGU |
| 1573 | UUUGUACA CUGAUGA X GAA AGCUGACA | UGUCAGUUU UGUACAAA |
| 1574 | AUUUGUAC CUGAUGA X GAA AAGCUGAC | GUCAGCUUU GUACAAAU |
| 1577 | CACAUUUG CUGAUGA X GAA ACAAAGCU | AGCUUUGUA CAAAUGUG |
| 1593 | ACUUUGUU CUGAUGA X GAA ACCGCUUC | GAAGCGGUC AACAAAGU |
| 1602 | CCUCUCCC CUGAUGA X GAA ACUUUGUU | AACAAAGUC GGGAGAGG |
| 1623 | UGGAAGGA CUGAUGA X GAA AUCACCCU | AGGGUGAUC UCCUUCCA |
| 1625 | CGUGGAAG CUGAUGA X GAA AGAUCACC | GGUGAUCUC CUUCCACG |
| 1628 | UCACGUGG CUGAUGA X GAA AGGAGAUC | GAUCUCCUU CCACGUGA |
| 1629 | GUCACGUG CUGAUGA X GAA AAGGAGAU | AUCUCCUUC CACGUGAC |
| 1645 | AAUUCAG CUGAUGA X GAA ACCCCUGG | CCAGGGUC CUGAAAUU |
| 1653 | UGCAAAGU CUGAUGA X GAA AUUUCAGG | CCUGAAAUU ACUUUGCA |
| 1654 | UUGCAAAG CUGAUGA X GAA AAUUUCAG | CUGAAAUUA CUUUGCAA |
| 1657 | AGGUUGCA CUGAUGA X GAA AGUAAUUU | AAAUUACUU UGCAACCU |
| 1658 | CAGGUUGC CUGAUGA X GAA AAGUAAUU | AAUUACUUU GCAACCUG |
| 1697 | ACCACAAA CUGAUGA X GAA ACACGCUC | GAGCGUGUC UUUGUGGU |
| 1699 | GCACCACA CUGAUGA X GAA AGACACGC | GCGUGUCUU UGUGGUGC |
| 1700 | UGCACCAC CUGAUGA X GAA AAGACACG | CGUGUCUUU GUGGUGCA |
| 1721 | CAAACGUA CUGAUGA X GAA AUCUGUCU | AGACAGAUC UACGUUUG |
| 1723 | CUCAAACG CUGAUGA X GAA AGAUCUGU | ACAGAUCUA CGUUUGAG |
| 1727 | GGUUCUCA CUGAUGA X GAA ACGUAGAU | AUCUACGUU UGAGAACC |
| 1728 | AGGUUCUC CUGAUGA X GAA AACGUAGA | UCUACGUUU GAGAACCU |
| 1737 | UACCAUGU CUGAUGA X GAA AGGUUCUC | GAAACCUC ACAUGGUA |
| 1745 | CAAGCUUG CUGAUGA X GAA ACCAUGUG | CACAUGGUA CAAGCUUG |
| 1752 | UGUGGGCC CUGAUGA X GAA AGCUUGUA | UACAAGCUU GGCCCACA |
| 1765 | GAUUGGCA CUGAUGA X GAA AGGCUGUG | CACAGCCUC UGCCAAUC |
| 1773 | CCCACAUG CUGAUGA X GAA AUUGGCAG | CUGCCAAUC CAUGUGGG |
| 1787 | GUGUGGGC CUGAUGA X GAA ACUCUCCC | GGGAGAGUU GCCCACAC |
| 1800 | UUCUUGCA CUGAUGA X GAA ACAGGUGU | ACACCUGUU UGCAAGAA |
| 1801 | GUUCUUGC CUGAUGA X GAA AACAGGUG | CACCUGUUU GCAAGAAC |
| 1811 | GAGUAUCC CUGAUGA X GAA AGUUCUUG | CAAGAACUU GGAUACUC |
| 1816 | CCAAAGAG CUGAUGA X GAA AUCCAAGU | ACUUGGAUA CUCUUUGG |
| 1819 | UUUCCAAA CUGAUGA X GAA AGUAUCCA | UGGAUACUC UUUGGAAA |
| 1821 | AAUUCCA CUGAUGA X GAA AGAGUAUC | GAUACUCUU UGGAAAUU |

Table IV-continued

Human KDR VEGF Receptor-Hammerhead Ribozyme and Substrate Sequence

| nt. Position | HH Ribozyme Sequence | Substrate |
|---|---|---|
| 1822 | CAAUUUCC CUGAUGA X GAA AAGAGUAU | AUACUCUUU GGAAAUUG |
| 1829 | UGGCAUUC CUGAUGA X GAA AUUUCCAA | UUGGAAAUU GAAUGCCA |
| 1844 | UAUUAGAG CUGAUGA X GAA ACAUGGUG | CACCAUGUU CUCUAAUA |
| 1845 | CUAUUAGA CUGAUGA X GAA AACAUGGU | ACCAUGUUC UCUAAUAG |
| 1847 | UGCUAUUA CUGAUGA X GAA AGAACAUG | CAUUUCUC UAAUAGCA |
| 1849 | UGUGCCAU CUGAUGA X GAA AGAGAACA | UGUUCUCUA AUAGCACA |
| 1852 | AUUUGUGC CUGAUGA X GAA AUUAGAGA | UCUCUAAUA GCACAAAU |
| 1866 | AUGAUCAA CUGAUGA X GAA AUGUCAUU | AAUGAGAUU UUGAUCAU |
| 1867 | CAUGAUCA CUGAUGA X GAA AAUGUCAU | AUGAGAUUU UGAUCAUG |
| 1868 | CCAUGAUC CUGAUGA X GAA AAAUGUCA | UGACAUUUU GAUCAUGG |
| 1872 | AGCUCCAU CUGAUGA X GAA AUCAAAAU | AUUGAUCUU AUGGAGCU |
| 1881 | GCAUUCUU CUGAUGA X GAA AGCUCCAU | AUGGAGCUU AAGAAUGC |
| 1882 | UGCAUUCU CUGAUGA X GAA AAGCUCCA | UGGAGCUUA AGAAUGCA |
| 1892 | CCUGCAAG CUGAUGA X GAA AUGCAUUC | GAAUGCAUC CUUGCAGG |
| 1895 | GGUCCUGC CUGAUGA X GAA AGGAUGCA | UGCAUCCUU GCAGGACC |
| 1913 | GGCAGACA CUGAUGA X GAA AGUCUCCU | AGGAGACUA UGUCUGCC |
| 1917 | GCAAGGCA CGGAUGA X GAA ACAUAGUC | GACUAUGUC UGCCUUGC |
| 1923 | UCUUGAGC CUGAUGA X GAA AGGCAGAC | GUCUGCCUU GCUCAAGA |
| 1927 | CCUGUCUU CUGAUGA X GAA AGCAAGGC | GCCUUGCUC AAGACAGG |
| 1954 | GACCACGC CUGAUGA X GAA AUGUCUUU | AAAGACAUU GCGUGGUC |
| 1962 | AGCUGCCU CUGAUGA X GAA ACCACGCA | UGCGUGGUC AGGCAGCU |
| 1971 | AGGACUGU CUGAUGA X GAA AGCUGCCU | AGGCAGCUC ACAGUCUU |
| 1977 | CGCUCUAG CUGAUGA X GAA ACUGUGAG | CUCACAGUC CUAGAGCG |
| 1980 | ACACGCUC CUGAUGA X GAA AGGACUGU | ACAGUCCUA GAGCGUGU |
| 2001 | UUUCCUGU CUGAUGA X GAA AUCGUGGG | CCCACGAUC ACAGGAAA |
| 2020 | UGUCGUCU CUGAUGA X GAA AUUCUCCA | UGGAGAAUC AGACGACA |
| 2032 | UUCCCCAA CUGAUGA X GAA ACUUGUCG | CGACAAGUA UUGGGGAA |
| 2034 | CUUUCCCC CUGAUGA X GAA AUACUUGU | ACAAGUAUU GGGGAAAG |
| 2046 | GAGACUUC CUGAUGA X GAA AUGCUUUC | GAAAGCAUC GAAGUCUC |
| 2052 | GUGCAUGA CUGAUGA X GAA ACUUCGAU | AUCGAAGUC UCAUGCAC |
| 2054 | CCGUGCAU CUGAUGA X GAA AGACUUCG | CGAAGUCUC AUGCACGG |
| 2066 | GAUUCCCA CUGAUGA X GAA AUGCCGUG | CACGCCAUC UGGGAAUC |
| 2074 | UGGAGGGG CUGAUGA X GAA AUUCCCAG | CUGGGAAUC CCCCUCCA |
| 2080 | GAUCUGUG CUGAUGA X GAA AGGGGGAU | AUCCCCCUC CACAGAUC |
| 2088 | AACCACAU CUGAUGA X GAA AUCUGUGG | CCACAGAUC AUGUGGUU |
| 2096 | UAUCUUUA CUGAUGA X GAA ACCACAUG | CAUGUGGUU UAAAGAUA |
| 2097 | UUAUCUUU CUGAUGA X GAA AACCACAU | AUGUGGUUU AAAGAUAA |

Table IV-continued

Human KDR VEGF Receptor-Hammerhead Ribozyme and Substrate Sequence

| nt. Position | HH Ribozyme Sequence | Substrate |
|---|---|---|
| 2098 | AUUAUCUU CUGAUGA X GAA AAACCACA | UGUGGUUUA AAGAUAAU |
| 2104 | GGUCUCAU CUGAUGA X GAA AUCUUUAA | UUAAAGAUA AUGAGACC |
| 2115 | UCUUCUAC CUGAUGA X GAA AGGGUCUC | GAGACCCUU GUAGAAGA |
| 2118 | GAGUCUUC CUGAUGA X GAA ACAAGGGU | ACCCUUGUA GAAGACUC |
| 2126 | CAAUGCCU CUGAUGA X GAA AGUCUUCU | AGAAGACUC AGGCAUUG |
| 2133 | UUCAAUAC CUGAUGA X GAA AUGCCUGA | UCAGGCAUU GUAUUGAA |
| 2136 | UCCUUCAA CUGAUGA X GAA ACAAUGCC | GCCAUUGUA UUGAAGGA |
| 2138 | CAUCCUUC CUGAUGA X GAA AUACAAUG | CAUUGUAUU GAAGGAUG |
| 2160 | CGGAUAGU CUGAUGA X GAA AGGUUCCG | CGGAACCUC ACUAUCCG |
| 2164 | UCUGCGGA CUGAUGA X GAA AGUGAGGU | ACCUCACUA UCCGCAGA |
| 2166 | ACUCUGCG CUGAUGA X GAA AUAGUGAG | CUCACUAUC CGCAGAGU |
| 2196 | CAGGUGUA CUGAUGA X GAA AGGCCUUC | GAAGGCCUC UACACCUG |
| 2198 | GGCAGGUG CUGAUGA X GAA AGAGGCCU | AGGCCUCUA CACCUGCC |
| 2220 | CAGCCAAG CUGAUGA X GAA ACACUGGA | UGCAGUGUU CUUGGCUG |
| 2221 | ACAGCCAA CUGAUGA X GAA AACACUGC | GCAGUGUUC UUGGCUGU |
| 2223 | GCACAGCC CUGAUGA X GAA AGAACACU | AGUGUUCUU GGCUGUGC |
| 2246 | UUAUGAAA CUGAUGA X GAA AUGCCUCC | GGAGGCAUU UUUCAUAA |
| 2247 | AUUAUGAA CUGAUGA X GAA AAUGCCUC | GAGGCAUUU UUCAUAAU |
| 2248 | UAUUAUGA CUGAUGA X GAA AAAUGCCU | AGGCAUUUU UCAUAAUA |
| 2249 | CUAUUAUG CUGAUGA X GAA AAAAUGCC | GGCAUUUUU CAUAAUAG |
| 2250 | UCUAUUAU CUGAUGA X GAA AAAAAUGC | GGAUUUUUC AUAAUAGA |
| 2253 | CCUUCUAU CUGAUGA X GAA AUGAAAAA | UUUUUCAUA AUAGAAGG |
| 2256 | GCACCUUC CUGAUGA X GAA AUUAUGAA | UUCAUAAUA GAAGGUGC |
| 2282 | UGAUUUCC CUGAUGA X GAA AGUUCGUC | GACGAACUU GGAAAUCA |
| 2289 | AGAAUAAU CUGAUGA X GAA AUUUCCAA | UUGGAAAUC AUUAUUCU |
| 2292 | ACUAGAAU CUGAUGA X GAA AUGAUUUC | GAAAUCAUU AUUCUAGU |
| 2293 | UACUAGAA CUGAUGA X GAA AAUGAUUU | AAAUCAUUA UUCUAGUA |
| 2295 | CCUACUAG CUGAUGA X GAA AUAAUGAU | AUCAUUAUU CUAGUAGG |
| 2296 | GCCUACUA CUGAUGA X GAA AAUAAUGA | UCAUUAUUC UAGUAGGC |
| 2298 | GUGCCUAC GUGAUGA X GAA AGAAUAAU | AUUAUUCUA GUAGGGAC |
| 2301 | GUCGUGCC CUGAUGA X GAA ACUAGAAU | AUUCUAGUA GGCACGAC |
| 2316 | AACAUGGC CUGAUGA X GAA AUCACCGU | ACGGUGAUU GCCAUGUU |
| 2324 | GCCAGAAG CUGAUGA X GAA ACAUGGCA | UGCCAUGUU CUUCUGGC |
| 2325 | AGCCAGAA CUGAUGA X GAA AACAUGGC | GCCAUGUUC UUCUGGCU |
| 2327 | GUAGCCAG CUGAUGA X GAA AGAACAUG | CAUGUUCUU CUGGCUAC |
| 2328 | AGUAGCCA GUGAUGA X GAA AAGAACAU | AUGUUCUUC UGGCUACU |

Table IV-continued

Human KDR VEGF Receptor-Hammerhead Ribozyme and Substrate Sequence

| nt. Position | HH Ribozyme Sequence | Substrate |
|---|---|---|
| 2334 | ACAAGAAG CUGAUGA X GAA AGCCAGAA | UUCUGGCUA CUUCUGGU |
| 2337 | AUGACAAG CUGAUGA X GAA AGUAGCCA | UGGCUACUU CUUGUCAU |
| 2338 | GAUGACAA CUGAUGA X GAA AGUAGCC | GGCUACUUC UUGUCAUC |
| 2340 | AUGAUGAC CUGAUGA X GAA AGAAGUAG | CUACUUCUU GUCAUCAU |
| 2343 | AGGAUGAU CUGAUGA X GAA ACAAGAAG | CUUCUUGUC AUCAUCCU |
| 2346 | CCUAGGAU CUGAUGA X GAA AUGACAAG | CUUGUCAUC AUCCUAGG |
| 2349 | GUCCUAG CUGAUGA X GAA AUGAUGAC | GUCAUCAUC CUAGGGAC |
| 2352 | ACGGUCCC CUGAUGA X GAA AGGAUGAU | AUCAUCCUA GGACCGU |
| 2361 | GCCCGCUU CUGAUGA X GAA ACGGUCCC | GGGACCGUU AAGCGGGC |
| 2362 | GGCCCGCU CUGAUGA X GAA AACGGUCC | GGACCGUUA AGCGGGCC |
| 2396 | UGGACAAG CUGAUGA X GAA AGCCUGUC | GACAGGCUA CUUGUCCA |
| 2399 | CGAUGGAC CUGAUGA X GAA AGUAGCCU | AGGCUACUU GUCCAUCG |
| 2402 | UGACGAUG CUGAUGA X GAA ACAAGUAG | CUACUUGUC CAUCGUCA |
| 2406 | UCCAUGAC CUGAUGA X GAA AUGGACAA | UUGUCCAUC GUCAUGGA |
| 2409 | GGAUCCAU CUGAUGA X GAA ACGAUGGA | UCCAUCGUC AUGGAUCC |
| 2416 | UUCAUCUG CUGAUGA X GAA AUCCAUGA | UCAUGGAUC CAGAUGAA |
| 2427 | UCCAAUGG CUGAUGA X GAA AGUUCAUC | GAUGAACUC CAUUGGA |
| 2432 | GUUCAUCC CUGAUGA X GAA AUGGGAGU | ACUCCCAUU GGAUGAAC |
| 2443 | UCGUUCAC CUGAUGA X GAA AUGUUCAU | AUGAACAUU GUGAACGA |
| 2458 | GGCAUCAU CUGAUGA X GAA AGGCAGUC | GACUGCCUU AUGAUGCC |
| 2459 | UGGCAUCA CUGAUGA X GAA AAGGCAGU | ACUGCCUUA UGAUGCCA |
| 2480 | CUCUGGGG CUGAUGA X GAA AUUCCCAU | AUGGGAAUU CCCCAGAG |
| 2481 | UCUCUGGG CUGAUGA X GAA AAUUCCCA | UGGGAAUUC CCCAGAGA |
| 2502 | GGCUUACC CUGAUGA X GAA AGGUUCAG | CUGAACCUA GGUAAGCC |
| 2506 | AAGAGGCU CUGAUGA X GAA ACCUAGGU | ACCUAGGUA AGCCUCUU |
| 2512 | ACGGCCAA CUGAUGA X GAA AGGCUUAC | GUAAGCCUC UUGGCCGU |
| 2514 | CCACGGCC CUGAUGA X GAA AGAGGCUU | AAGCCUCUU GGCCGUGG |
| 2528 | CUUGGCCA CUGAUGA X GAA AGGCACCA | UGGUGCCUU UGGCCAAG |
| 2529 | UCUUGGCC CUGAUGA X GAA AAGGCACC | GGUGCCUUU GGCCAAGA |
| 2541 | UCUGCUUC CUGAUGA X GAA AUCUCUUG | CAAGAGAUU GAAGCAGA |
| 2555 | CAAUUCCA CUGAUGA X GAA AGGCAUCU | AGAUGCCUU UGGAAUUG |
| 2556 | UCAAUUCC CUGAUGA X GAA AAGGCAUC | GAUGCCUUU GGAAUUGA |
| 2562 | GUCUUGUC CUGAUGA X GAA AUUCGAAA | UUUGGAAUU GACAAGAC |
| 2578 | UGUCCUGC CUGAUGA X GAA AGUUGCUG | CAGCAACUU GCAGGACA |
| 2589 | UUGACUGC CUGAUGA X GAA ACUGUCCU | AGGACAGUA GCAGUCAA |
| 2595 | AACAUUUU CUGAUGA X GAA ACUGCUAC | GUAGCAGUC AAAAUGUU |
| 2603 | CUUCUUUC CUGAUGA X GAA ACAUUUUG | CAAAAUGUU GAAAGAAG |

Table IV-continued

Human KDR VEGF Receptor-Hammerhead Ribozyme and Substrate Sequence

| nt. Position | HH Ribozyme Sequence | Substrate |
|---|---|---|
| 2632 | GAGAGCUC CUGAUGA X GAA AUGCUCAC | GUGAGCAUC GAGCUCUC |
| 2638 | AGACAUGA CUGAUGA X GAA AGCUCGAU | AUCGAGCUC UCAUGUCU |
| 2640 | UCAGACAU CUGAUGA X GAA AGAGCUCG | CGAGCUCUC AUGUCUGA |
| 2645 | UGAGUUCA CUGAUGA X GAA ACAUGAGA | UCUCAUGUC UGAACUCA |
| 2652 | AGGAUCUU CUGAUGA X GAA AGUUCAGA | UCUGAACUC AAGAUCCU |
| 2658 | UGAAUGAG CUGAUGA X GAA AUCUUGAG | CUCAAGAUC UCAUUCA |
| 2661 | AUAUGAAU CUGAUGA X GAA AGGAUCUU | AAGAUCCUC AUUCAUAU |
| 2664 | CCAAGAUG CUGAUGA X GAA AUGAGGAU | AUCCUCAUU CAUAUUGG |
| 2665 | ACCAAUAU CUGAUGA X GAA AAUGAGGA | UCCUCAUUC AUAUUGGU |
| 2668 | GUGACCAA CUGAUGA X GAA AUGAAUGA | UCAUUCAUA UUGGUCAC |
| 2670 | UGGGGACC CUGAUGA X GAA AUAUGAAU | AUUCAUAUU GGUCACCA |
| 2674 | GAGAUGGU CUGAUGA X GAA ACCAAUAU | AUAUUGGUC ACCAUCUC |
| 2680 | CACAUUGA CUGAUGA X GAA AUGGUGAC | GUCACCAUC UCAAUGUG |
| 2682 | ACCACAUU CUGAUGA X GAA AGAUGGUG | CACCAUCUC AAUGUGGU |
| 2691 | AGAAGGUU CUGAUGA X GAA ACCACAUU | AAUGUGGUC AACCUUCU |
| 2697 | GCACCUAG CUGAUGA X GAA AGGUUGAC | GUCAACCUU CUAGGUGC |
| 2698 | GGCACCUA CUGAUGA X GAA AAGGUUGA | UCAACCUUC UAGGUGCC |
| 2700 | CAGGCACC CUGAUGA X GAA AGAAGGUU | AACCUUCUA GGUGCCUG |
| 2710 | UGGCUUGG CUGAUGA X GAA ACAGGCAC | GUGCCUGUA CCAAGCCA |
| 2730 | AUCACCAU CUGAUGA X GAA AGUGGCCC | GGGCCACUC AUGUUGAU |
| 2739 | AAUCCAC CUGAUGA X GAA AUCACCAU | AUGGUGAUU GUGGAAUU |
| 2747 | AUUUGCAG CUGAUGA X GAA AUUCCACA | UGUGGAAUU CUGCAAAU |
| 2748 | AAUUUGCA CUGAUGA X GAA AAUUCCAC | GUGGAAUUC UGCAAAUU |
| 2756 | GGUUUCCA CUGAUGA X GAA AUUUGCAG | CUGCAAAUU UGGAAACC |
| 2757 | AGGUUUCC CUGAUGA X GAA AAUUUGCA | UGCAAAUUU GGAAACCU |
| 2768 | GGUAAGUG CUGAUGA X GAA ACAGGUUU | AAACCUGUC CACUUACC |
| 2773 | CCUCAGGU CUGAUGA X GAA AGUGGACA | UGUCCACUU ACCUGAGG |
| 2774 | UCCUCAGG CUGAUGA X GAA AAGUGGAC | GUCCACUUA CCUGAGGA |
| 2798 | AGGGGACA CUGAUGA X GAA AUUCAUUU | AAAUGAAUU UGUCCCCU |
| 2799 | UAGGGGAC CUGAUGA X GAA AAUUCAUU | AAUGAAUUU GUCCCCUA |
| 2802 | UUGUAGGG CUGAUGA X GAA ACAAAUUC | GAAUUUGUC CCUACAA |
| 2807 | UGGUCUUG CUGAUGA X GAA AGGGGACA | UGUCCCCUA CAAGACCA |
| 2828 | CUUGACGG CUGAUGA X GAA AUCGUGCC | GGCACGAUU CCGUCAAG |
| 2829 | CCUUGACG CUGAUGA X GAA AAUCGUGC | GCACGAUUC CGUCAAGG |
| 2833 | UUUCCCUU CUGAUGA X GAA ACGGAAUC | GAUUCCGUC AAGGGAAA |
| 2846 | CUCCAACG CUGAUGA X GAA AGUCUUUC | GAAAGACUA CGUUGGAG |

Table IV-continued

Human KDR VEGF Receptor-Hammerhead Ribozyme and Substrate Sequence

| nt. Position | HH Ribozyme Sequence | Substrate |
|---|---|---|
| 2850 | AUUGCUCC CUGAUGA X GAA ACGUAGUC | GACUACGUU GGAGCAAU |
| 2859 | UCCACAGG CUGAUGA X GAA AUUGCUCC | GGAGCAAUC CCUGUGGA |
| 2869 | CCGUUUCA CUGAUGA X GAA AUCCACAG | CUGUGGAUC UGAAACGG |
| 2882 | UGCUGUCC CUGAUGA X GAA AGCGCCGU | ACGGCGCUU GGACAGCA |
| 2892 | CUACUGGU CUGAUGA X GAA AUGCUGUC | GACAGCAUC ACCAGUAG |
| 2899 | GCUCUGGC CUGAUGA X GAA ACUGGUGA | UCACCAGUA GCCAGAGC |
| 2909 | AGCUGGCU CUGAUGA X GAA AGCUCUGG | CCAGAGCUC AGCCAGCU |
| 2918 | CAAAUCCA CUGAUGA X GAA AGCUGGCU | AGCCAGCUC UGGAUUUG |
| 2924 | CCUCCACA CUGAUGA X GAA AUCCAGAG | CUCUGGAUU UGUGGAGG |
| 2925 | UCCUCCAC CUGAUGA X GAA AAUCCAGA | UCUGGAUUU GUGGAGGA |
| 2939 | CACUGAGG CUGAUGA X GAA ACUUCUCC | GGAGAAGUC CCUCAGUG |
| 2943 | ACAUCACU CUGAUGA X GAA AGGGACUU | AAGUCCCUC AGUGAUGU |
| 2952 | UCUUCUUC CUGAUGA X GAA ACAUCACU | AGUGAUGUA GAAGAAGA |
| 2968 | AUCUUCAG CUGAUGA X GAA AGCUUCCU | AGGAAGCUC CUGAAGAU |
| 2977 | CUUAUACA CUGAUGA X GAA AUCUUGAG | CUGAAGAUC UGUAUAAG |
| 2981 | AGUCCUUA CUGAUGA X GAA ACAGAUCU | AGAUCUGUA UAAGGACU |
| 2983 | GAAGUCCU CUGAUGA X GAA AUACAGAU | AUCUGUAUA AGGACUUC |
| 2990 | AGGUCAGG CUGAUGA X GAA AGUCCUUA | UAAGGACUU CCUGACCU |
| 2991 | AAGGUCAG CUGAUGA X GAA AAGUCCUU | AAGGACUUC CUGACCUU |
| 2999 | GAUGCUCC CUGAUGA X GAA AGGUCAGG | CCUGACCUU GGAGCAUC |
| 3007 | ACAGAUGA CUGAUGA X GAA AUGCUCCA | UGGAGCAUC UCAUCUGU |
| 3009 | UAACAGAU CUGAUGA X GAA AGAUGCUC | GAGCAUCUC AUCUGUUA |
| 3012 | CUGUAACA CUGAUGA X GAA AUGAGAUG | CAUCUCAUC UGUUACAG |
| 3016 | GAAGCUGU CUGAUGA X GAA ACAGAUGA | UCAUCUGUU ACAGCUUC |
| 3017 | GGAAGCUG CUGAUGA X GAA AACAGAUG | CAUCUGUUA CAGCUUCC |
| 3023 | CCAGUGGG CUGAUGA X GAA AGCUGUAA | UUACAGCUU CCAAGGGG |
| 3024 | GCCACUUG CUGAUGA X GAA AAGCUGUA | UACAGCUUC CAAGUGGC |
| 3034 | CAUGCCCU CUGAUGA X GAA AGCCACUU | AAGUGGCUA AGGGCAUG |
| 3047 | AUGCCAAG CUGAUGA X GAA ACUCCAUG | CAUGGAGUU CUUGGCAU |
| 3048 | GAUGCCAA CUGAUGA X GAA AACUCCAU | AUGGAGUUC UUGGCAUC |
| 3050 | GCGAUGCC CUGAUGA X GAA AGAACUCC | GGAGUUCUU GGCAUCGC |
| 3056 | ACUUUCGC CUGAUGA X GAA AUGCCAAG | CUGGGCAUC GCGAAAGU |
| 3067 | CCUGUGGA CUGAUGA X GAA ACACUUUC | GAAAGUGUA UCCACAGG |
| 3069 | UCCCUGUG CUGAUGA X GAA AUACACUU | AAGGGUAUC CACAGGGA |
| 3094 | UAAGAGGA CUGAUGA X GAA AUUUCGUG | CAGAAAAUA UCCUCUUA |
| 3096 | GAUAAGAG CUGAUGA X GAA AUAUUUCG | CGAAAUAUC CUCUUAUC |
| 3099 | UCCGAUAA CUGAUGA X GAA AGGAUAUU | AAUAUCCUC UUAUCGGA |

Table IV-continued

Human KDR VEGF Receptor-Hammerhead Ribozyme and Substrate Sequence

| nt. Position | HH Ribozyme Sequence | Substrate |
|---|---|---|
| 3101 | UCUCCGAU CUGAUGA X GAA AGAGCAUA | UAUCCUCUU AUCGGAGA |
| 3102 | UUCUCCGA CUGAUGA X GAA AAGAGGAU | AUCCUCUUA UCGGAGAA |
| 3104 | UCUUCUCC CUGAUGA X GAA AUAAGAGG | CCUCUUAUC GGAGAAGA |
| 3120 | CAGAUUUU CUGAUGA X GAA ACCACGUU | AACGUGGUU AAAAUCUG |
| 3121 | ACAGAUUU CUGAUGA X GAA AACCACGU | ACGUGGUUA AAAUCUGU |
| 3126 | AAGUCACA CUGAUGA X GAA AUUUUAAC | GUUAAAAUC UGUGACUU |
| 3134 | CCAAGCCA CUGAUGA X GAA AGUCACAG | CUGUGACUU UGGCUUGG |
| 3135 | GCCAAGCC CUGAUGA X GAA AAGUCAGA | UGUGACUUU GGCUUGGC |
| 3140 | CCCGGGCC CUGAUGA X GAA AGCCAAAG | CUUUGGCUU GGCCCGGG |
| 3151 | UUUAUAAA CUGAUGA X GAA AUCCCGGG | CCCGGGAUA UUUAUAAA |
| 3153 | UCUUUAUA CUGAUGA X GAA AUAUCCCG | CGGGAUAUU UAUAAAGA |
| 3154 | AUCUUUAU CUGAUGA X GAA AAUAUCCC | GGGAUAUUU AUAAAGAU |
| 3155 | GAUCUUUA CUGAUGA X GAA AAAUAUCC | GGAUAUUUA UAAAGAUC |
| 3157 | UGGAUCUU CUGAUGA X GAA AUAAAUAU | AUAUUUAUA AAGAUCCA |
| 3163 | AUAAUCUG CUGAUGA X GAA AUCUUUAU | AUAAAGAUC CAGAUUAU |
| 3169 | UCUGACAU CUGAUGA X GAA AUCUGGAU | AUCCAGAUU AUGUCAGA |
| 3170 | UUCUGACA CUGAUGA X GAA AAUCUGGA | UCCAGAUUA UGUCAGAA |
| 3174 | CCUUUUCU CUGAUGA X GAA ACAUAAUC | GAUUAUGUC AGAAAAGG |
| 3190 | AGGGAGGC CUGAUGA X GAA AGCAUCUC | GAGAUGCUC GCCUCCCU |
| 3195 | UUCAAAGG CUGAUGA X GAA AGGCGAGC | GCUCGCCUC CCUUUGAA |
| 3199 | CCAUUUCA CUGAUGA X GAA AGGGAGGC | GCCUCCCUU UGAAAUGG |
| 3200 | UCCAUUUC CUGAUGA X GAA AAGGGAGG | CCUCCCUUU GAAAUGGA |
| 3225 | CUGUCAAA CUGAUGA X GAA AUUGUUUC | GAAACAAUU UUUGACAG |
| 3226 | UCUGUCAA CUGAUGA X GAA AAUUGUUU | AAACAAUUU UUGACAGA |
| 3227 | CUCUGUCA CUGAUGA X GAA AAAUUGUU | AACAAUUUU UGACAGAG |
| 3228 | ACUCUGUC CUGAUGA X GAA AAAAUUGU | ACAAUUUUU GACAGAGU |
| 3239 | GGAUUGUG CUGAUGA X GAA ACACUCUG | CAGAGUGUA CACAAUCC |
| 3246 | UCACUCUG CUGAUGA X GAA AUUGUGUA | UACACAAUC CAGAGUGA |
| 3258 | AAAGACCA CUGAUGA X GAA ACGUCACU | AGUGACGUC UGGUCUUU |
| 3263 | CACCAAAA CUGAUGA X GAA ACCAGACG | CGUCUGGUC UUUUGGUG |
| 3265 | AACACCAA CUGAUGA X GAA AGACCAGA | UCUGGUCUU UUGGUGUU |
| 3266 | AAACACCA CUGAUGA X GAA AAGACCAG | CUGGUCUUU UGGUGUUU |
| 3267 | AAAACACC CUGAUGA X GAA AAAGACCA | UGGUCUUUU GGUGUUUU |
| 3273 | CACAGCAA CUGAUGA X GAA ACACCAAA | UUUGGUGUU UUGCUGUG |
| 3274 | CCACAGCA CUGAUGA X GAA AACACCAA | UUGGUGUUU UGCUGUGG |
| 3275 | CCCACGGC CUGAUGA X GAA AAACACCA | UGGUGUUUU GCUGUGGG |

Table IV-continued

Human KDR VEGF Receptor-Hammerhead Ribozyme and Substrate Sequence

| nt. Position | HH Ribozyme Sequence | Substrate |
|---|---|---|
| 3288 | AAGGAAAA CUGAUGA X GAA AUUUCCCA | UGGGAAAUA UUUUCCUU |
| 3290 | CUAAGGAA CUGAUGA X GAA AUAUUUCC | GCAAAUAUU UUCCUUAG |
| 3291 | CCUAAGGA CUGAUGA X GAA AAUAUUUC | GAAAUAUUU UCCUUAGG |
| 3292 | ACCUAAGG CUGAUGA X GAA AAAUAUUU | AAAUAUUUU CCUUAGGU |
| 3293 | CACCUAAG CUGAUGA X GAA AAAAUAUU | AAUAUUUUC CUUAGGUG |
| 3296 | AAGCACCU CUGAUGA X GAA AGGAAAAU | AUUUUCCUU AGGUGCUU |
| 3297 | GAAGCACC CUGAUGA X GAA AAGGAAAA | UUUUCCUUA GGUGCUUC |
| 3304 | AUAUGGAG CUGAUGA X GAA AGCACCUA | UAGGUGCUU CUCCAUAU |
| 3305 | GAUAUGGA CUGAUGA X GAA AAGCACCU | AGGUGCUUC UCCAUAUC |
| 3307 | AGGAUAUG CUGAUGA X GAA AGAAGCAC | GUGCUUCUC CAUAUCCU |
| 3311 | CCCCAGGA CUGAUGA X GAA AUGGAGAA | UUCUCCAUA UCCUGGGG |
| 3313 | UACCCCAG CUGAUGA X GAA AUAUGGAG | CUCCAUAUC CUGGGGUA |
| 3321 | UCAAUCUU CUGAUGA X GAA ACCCCAGG | CCUGGGGUA AAGAUUGA |
| 3327 | UCUUCAUC CUGAUGA X GAA AUCUUUAC | GUAAAGAUU GAUGAAGA |
| 3338 | GCCUACAA CUGAUGA X GAA AUUCUUCA | UGAAGAAUU UUGUAGGC |
| 3339 | CGCCUACA CUGAUGA X GAA AAUUCUUC | GAAGAAUUU UGUAGGCG |
| 3340 | UCGCCUAC CUGAUGA X GAA AAAUUCUU | AAGAAUUUU GUAGGCGA |
| 3343 | CAAUCGCC CUGAUGA X GAA ACAAAAUU | AAUUUUGUA GGCGAUUG |
| 3350 | CUUCUUUC CUGAUGA X GAA AUCGCCUA | UAGGCGAUU GAAAGAAG |
| 3364 | CCUCAUUC CUGAUGA X GAA AGUUCCUU | AAGGAACUA GAAUGAGG |
| 3382 | UGUAGUAU CUGAUGA X GAA AUCAGGGG | CCCCUGAUU AUACUACA |
| 3383 | GUGUAGUA CUGAUGA X GAA AAUCAGGG | CCCUGAUUA UACUACAC |
| 3385 | UGGUGUAG CUGAUGA X GAA AUAAUCAG | CUGAUUAUA CUACACCA |
| 3388 | UUCUGGUG CUGAUGA X GAA AGUAUAAU | AUUAUACUA CACCAGAA |
| 3401 | UGGUCUGG CUGAUGA X GAA ACAUUUCU | AGAAAUGUA CCAGACCA |
| 3439 | GGGUCUCU CUGAUGA X GAA ACUGGGCU | AGCCCAGUC AGAGACCC |
| 3452 | ACUCUGAA CUGAUGA X GAA ACGUGGGU | ACCCACGUU UUCAGAGU |
| 3453 | AACUCUGA CUGAUGA X GAA AACGUGGG | CCCACGUUU UCAGAGUU |
| 3454 | CAACUCUG CUGAUGA X GAA AAACGUGG | CCACGUUUU CAGAGUUG |
| 3455 | CCAACUCU CUGAUGA X GAA AAAACGUG | CACGUUUUC AGAGUUGG |
| 3461 | GUUCCACC CUGAUGA X GAA ACUCUGAA | UUCAGAGUU GGUGGAAC |
| 3472 | AUUUCCCA CUGAUGA X GAA AUGUUCCA | UGGAACAUU UGGGAAAU |
| 3473 | GAUUUCCC CUGAUGA X GAA AAUGUUCC | GGAACAUUU GGGAAAUC |
| 3481 | UUGCAAGA CUGAUGA X GAA AUUUCCCA | UGGGAAAUC UCUUGCAA |
| 3483 | GCUUGCAA CUGAUGA X GAA AGAUUUCC | GAAAUCUCU UGCAAGC |
| 3485 | UAGCUUGC CUGAUGA X GAA AGAGAUUU | AAAUCUCUU GCAAGCUA |
| 3493 | CUGAGCAU CUGAUGA X GAA AGCUUGCA | UGCAAGCUA AUGCUCAG |

Table IV-continued

Human KDR VEGF Receptor-Hammerhead Ribozyme and Substrate Sequence

| nt. Position | HH Ribozyme Sequence | Substrate |
|---|---|---|
| 3499 | AUCCUGCU CUGAUGA X GAA AGCAUUAG | CUAAUGCUC AGCAGGAU |
| 3518 | GAACAAUG CUGAUGA X GAA AGUCUUUG | CAAAGACUA CAUUGUUC |
| 3522 | GGAAGAAC CUGAUGA X GAA AUGUAGUC | GACUACAUU GUUCUUCC |
| 3525 | AUCGGAAG CUGAUGA X GAA ACAAUGUA | UACAUUGUU CUUCCGAU |
| 3526 | UAUCGGAA CUGAUGA X GAA AACAAUGU | ACAUUGUUC UUCCGAUA |
| 3528 | GAUAUCGG CUGAUGA X GAA AGAACAAU | AUUGUUCUU CCGAUAUC |
| 3529 | UGAUAUCG CUGAUGA X GAA AAGAACAA | UUGUUCUUC CGAUAUCA |
| 3534 | GUCUCUGA CUGAUGA X GAA AUCGGAAG | CUUCCGAUA UCAGAGAC |
| 3536 | AAGUCUCU CUGAUGA X GAA AUAUCGGA | UCCGAUAUC AGAGACUU |
| 3544 | CAUGCUCA CUGAUGA X GAA AGUCUCUG | CAGAGACUU UGAGCAUG |
| 3545 | CCAUGCUC CUGAUGA X GAA AAGUCUCU | AGAGACUUU GAGCAUGG |
| 3562 | GAGUCCAG CUGAUGA X GAA AUCCUCUU | AAGAGGAUU CUGGACUC |
| 3563 | AGAGUCCA CUGAUGA X GAA AAUCCUCU | AGAGGAUUC UGGACUCU |
| 3570 | GGCAGAGA CUGAUGA X GAA AGUCCAGA | UCUGGACUC UCUCUGCC |
| 3572 | UAGGCAGA CUGAUGA X GAA AGAGUCCA | UGGACUCUC UCUGCCUA |
| 3574 | GGUAGGCA CUGAUGA X GAA AGAGAGUC | GACUCUCUC UGCCUACC |
| 3580 | AGGUGAGG CUGAUGA X GAA AGGCAGAG | CUCUGCCUA CCUCACCU |
| 3584 | AAACAGGU CUGAUGA X GAA AGGUAGGC | GCCUACCUC ACCUGUUU |
| 3591 | AUACAGGA CUGAUGA X GAA ACAGGUGA | UCACCUGUU UCCUGUAU |
| 3592 | CAUACAGG CUGAUGA X GAA AACAGGUG | CACCUGUUU CCUGUAUG |
| 3593 | CCAUACAG CUGAUGA X GAA AAACAGGU | ACCUGUUUC CUGUAUGG |
| 3598 | CUCCUCCA CUGAUGA X GAA ACAGGAAA | UUUCCUGUA UGGAGGAG |
| 3615 | GGGUCACA CUGAUGA X GAA ACUUCCUC | GAGGAAGUA UGUGACCC |
| 3629 | CAUAAUGG CUGAUGA X GAA AUUUGGGG | CCCCAAAUU CCAUUAUG |
| 3630 | UCAUAAUG CUGAUGA X GAA AAUUUGGG | CCCAAAUUC CAUUAUGA |
| 3634 | GUUGUCAU CUGAUGA X GAA AUGGAAUU | AAUUCCAUU AUGACAAC |
| 3635 | UGUUGUCA CUGAUGA X GAA AAUGGAAU | AUUCCAUUA UGACAACA |
| 3654 | UACUGACU CUGAUGA X GAA AUUCCUGC | GCAGGAAUC AGUCAGUA |
| 3658 | CAGAUACU CUGAUGA X GAA ACUGAUUC | GAAUCAGUC AGUAUCUG |
| 3662 | UCUGCAGA CUGAUGA X GAA ACUGACUG | CAGUGAGUA UCUGCAGA |
| 3664 | GUUCUGCA CUGAUGA X GAA AUACUGAC | GUCAGUAUC UGCAGAAC |
| 3676 | CUUUCGCU CUGAUGA X GAA ACUGUUCU | AGAACAGUA AGCGAAAG |
| 3702 | AAUGUUUU CUGAUGA X GAA ACACUCAC | GUGAGUGUA AAAACAUU |
| 3710 | UAUCUUCA CUGAUGA X GAA AUGUUUUU | AAAAACAUU UGAAGAUA |
| 3711 | AUAUCUUC CUGAUGA X GAA AAUGUUUU | AAAACAUUU GAAGAUAU |
| 3718 | UAACGGGA CUGAUGA X GAA AUCUUCAA | UUGAAGAUA UCCCGUUA |

Table IV-continued

Human KDR VEGF Receptor-Hammerhead Ribozyme and Substrate Sequence

| nt. Position | HH Ribozyme Sequence | Substrate |
|---|---|---|
| 3720 | UCUAACGG CUGAUGA X GAA AUAUCUUC | GAAGAUAUC CCGUUAGA |
| 3725 | GUUCUUCU CUGAUGA X GAA ACGGGAUA | UAUCCCGUU AGAAGAAC |
| 3726 | GGUUCUUC CUGAUGA X GAA AACGGGAU | AUCCCGUUA GAAGAACC |
| 3741 | AUUACUUU CUGAUGA X GAA ACUUCUGG | CCAGAAGUA AAAGUAAU |
| 3747 | UCUGGGAU CUGAUGA X GAA ACUUUUAC | GUAAAAGUA AUCCCAGA |
| 3750 | UCAUCUGG CUGAUGA X GAA AUUACUUU | AAAGUAAUC CCAGAUGA |
| 3778 | AAGAACCA CUGAUGA X GAA ACCACUGU | ACAGUGGUA UGGUUCUU |
| 3783 | GAGGCAAG CUGAUGA X GAA ACCAUACC | GGUAUGGUU CUUGCCUC |
| 3784 | UGAGGCAA CUGAUGA X GAA AACCAUAC | GUAUGGUUC UUGCCUCA |
| 3786 | UCUGAGGC CUGAUGA X GAA AGAACCAU | AUGGUUCUU GCCUCAGA |
| 3791 | GCUCUUCU CUGAUGA X GAA AGGCAAGA | UCUUGCCUC AGAAGAGC |
| 3808 | GUCUUCCA CUGAUGA X GAA ACUUUUCA | UGAAAACUU UGGAAGAC |
| 3809 | UGUCUUCC CUGAUGA X GAA AAGUUUUC | GAAAACUUU GGAAGACA |
| 3827 | AUGGAGAU CUGAUGA X GAA AUUUGGUU | AACCAAAUU AUCUCCAU |
| 3828 | GAUGGAGA CUGAUGA X GAA AAUUUGGU | ACCAAAUUA UCUCCAUC |
| 3830 | AAGAUGGA CUGAUGA X GAA AUAAUUUG | CAAAUUAUC UCCAUCUU |
| 3832 | AAAAGAUG CUGAUGA X GAA AGAUAAUU | AAUUAUCUC CAUCUUUU |
| 3836 | CACCAAAA CUGAUGA X GAA AUGGAGAU | AUCUCCAUC UUUUGGUG |
| 3838 | UCCACCAA CUGAUGA X GAA AGAUGGAG | CUCCAUCUU UUGGUGGA |
| 3839 | UUCCACCA CUGAUGA X GAA AAGAUGCA | UCCAUCUUU UGGUGGAA |
| 3840 | AUUCCACC CUGAUGA X GAA AAAGAUGG | CCAUCUUUU GGUGGAAU |
| 3872 | AUGCCACA CUGAUGA X GAA ACUCCCUG | CAGGGAGUC UGUGGCAU |
| 3881 | AGCCUUCA CUGAUGA X GAA AUGCCACA | UGUGGCAUC UGAAGGCU |
| 3890 | UCUGGUUU CUGAUGA X GAA AGCCUUCA | UGAAGGCUC AAACCAGA |
| 3908 | CGGACUGG CUGAUGA X GAA AGCCGCUU | AAGCGGCUA CCAGUCCG |
| 3914 | GAUAUCCG CUGAUGA X GAA ACUGGUAG | CUACCAGUC CGGAUAUC |
| 3920 | CGGAGUGA CUGAUGA X GAA AUCCGCAC | GUCCGGAUA UCACUCCG |
| 3922 | AUCGGAGU CUGAUGA X GAA AUAUCCGG | CCGGAUAUC ACUCCGAU |
| 3926 | UGUCAUCG CUGAUGA X GAA AGUGAUAU | AUAUCACUC CGAUGACA |
| 3950 | CACUGGAG CUGAUGA X GAA ACACGGUG | CACCGUGUA CUCCAGUG |
| 3953 | CCUCACUG CUGAUGA X GAA AGUACACG | CGUGUACUC CAGUGAGG |
| 3972 | AGCUUUAA CUGAUGA X GAA AGUUCUGC | GCAGAACUU UUAAAGCU |
| 3973 | CAGCUUUA CUGAUGA X GAA AAGUUCUG | CAGAACUUU UAAAGCUG |
| 3974 | UCAGCUUU CUGAUGA X GAA AAAGUUCU | AGAACUUUU AAAGCUGA |
| 3975 | AUCAGCUU CUGAUGA X GAA AAAAGUUC | GAACUUUUA AAGCUGAU |
| 3984 | CCAAUCUC CUGAUGA X GAA AUCAGCUU | AAGCUGAUA GAGAUGGG |
| 3990 | UGGACUCC CUGAUGA X GAA AUCUCUAU | AUAGAGAUU GGAGUGCA |

Table IV-continued

Human KDR VEGF Receptor-Hammerhead Ribozyme and Substrate Sequence

| nt. Position | HH Ribozyme Sequence | Substrate |
|---|---|---|
| 4006 | GGCUGUGC CUGAUGA X GAA ACCGGUUU | AAACCGGUA GCACAGCC |
| 4020 | GGCUGGAG CUGAUGA X GAA AUCUGGGC | GCCCAGAUU CUCCAGCC |
| 4021 | AGGCUGGA CUGAUGA X GAA AAUCUGGG | CCCAGAUUC UCCAGCCU |
| 4023 | UCAGGCUG CUGAUGA X GAA AGAAUCUG | CAGAUUCUC CAGCCUGA |
| 4052 | CAGGAGGA CUGAUGA X GAA AGCUCAGU | ACUGAGCUC UCCUCCUG |
| 4054 | AACAGGAG CUGAUGA X GAA AGAGGUCA | UGAGCUCUC CUCCUGUU |
| 4057 | UUAAACAG CUGAUGA X GAA AGGAGAGC | GCUCUCCUC CUGUUUAA |
| 4062 | UCCUUUUA CUGAUGA X GAA ACGGGAGG | CCUCCUGUU UAAAAGGA |
| 4063 | UUCCUUUU CUGAUGA X GAA AACAGGAG | CUCCUGUUU AAAAGGAA |
| 4064 | CUUCCUUU CUGAUGA X GAA AAACAGGA | UCCUGUUUA AAAGGAAG |
| 4076 | GGGGUGUG CUGAUGA X GAA AUGCUUCC | GGAAGCAUC CACACCCC |
| 4089 | AUGUCCGG CUGAUGA X GAA AGUUGGGG | CCCCAACUC CCGGACAU |
| 4098 | UCUCAUGU CUGAUGA X GAA AUGUCCGG | CCGGACAUC ACAUGAGA |
| 4110 | UCUGAGCA CUGAUGA X GAA ACCUCUCA | UGAGAGGUC UGCUCAGA |
| 4115 | CAAAAUCU CUGAU&A X GAA AGCAGACC | GGUCUGCUC AGAUUUUG |
| 4120 | CACUUCAA CUGAUGA X GAA AUCUGAGC | GCUCAGAUU UUGAAGUG |
| 4121 | ACAUCUUA CUGAUGA X GAA AAUCUGAG | CUGAGAUUU UGAAGUGU |
| 4122 | AACACUUC CUGAUGA X GAA AAAUCUGA | UCAGAUUUU GAAGUGUU |
| 4130 | GAAAGAAC CUGAUGA X GAA ACACUUCA | UGAAGUGUU GUUCUUUC |
| 4133 | GUGGAAAG CUGAUGA X GAA ACAACACU | AGUGUUGUU CUUUCCAC |
| 4134 | GGUGGAAA CUGAUGA X GAA AACAACAC | GUGUUGUUC UUUCCACC |
| 4136 | CUGGUGGA CUGAUGA X GAA AGAACAAC | GUUGUUCUU UCCACCAG |
| 4137 | GCUGGUGG CUGAUGA X GAA AAGAACAA | UUGUUCUUU CCACCAGC |
| 4138 | UGCUGGUG CUGAUGA X GAA AAAGAACA | UGUUCUUUC CACCAGCA |
| 4153 | AAUGCGGC CUGAUGA X GAA ACUUCCUG | CAGGAAGUA GCCGCAUU |
| 4161 | GAAAAUCA CUGAUGA X GAA AUGCGGCU | AGCCGCAUU UGAUUUUC |
| 4162 | UGAAAAUC CUGAUGA X GAA AAUGCGGC | GCCGCAUUU GAUUUUCA |
| 4166 | GAAAUGAA CUGAUGA X GAA AUCAAAUG | CAUUUGAUU UUCAUUUC |
| 4167 | CGAAAUGA CUGAUGA X GAA AAUCAAAU | AUUUGAUUU UCAUUUCG |
| 4168 | UCGAAAUG CUGAUGA X GAA AAAUCAAA | UUUGAUUUU CAUUUCGA |
| 4169 | GUCGAAAU CUGAUGA X GAA AAAAUCAA | UUGAUUUUC AUUUCGAC |
| 4172 | GUUGUCGA CUGAUGA X GAA AUGAAAAU | AUUUUCAUU UCGACAAC |
| 4173 | UGUUGUCG CUGAUGA X GAA AAUGAAAA | UUUUCAUUU CGACAACA |
| 4174 | CUGUUGUC CUGAUGA X GAA AAAUGAAA | UUUCAUUUC GACAACAG |
| 4194 | UGGAGUCC CUGAUGA X GAA AGGUCCUU | AAGGACCUC GGACUGCA |
| 4214 | GCCUAGAA CUGAUGA X GAA AGCUGGCU | AGCCAGCUC UUCUAGGC |

Table IV-continued

Human KDR VEGF Receptor-Hammerhead Ribozyme and Substrate Sequence

| nt. Position | HH Ribozyme Sequence | Substrate |
|---|---|---|
| 4216 | AAGCCUAG CUGAUGA X GAA AGAGCUGG | CCAGCUCUU CUAGGCUU |
| 4217 | CAAGCCUA CUGAUGA X GAA AAGAGCUG | CAGCUCUUC UAGGCUUG |
| 4219 | CACAAGCC CUGAUGA X GAA AGAAGAGC | GCUCUUCUA GGCUUGUG |

Where "X" represents stem II region of a HH ribozyme (Hertel et al., 1992 Nucleic Acids Res. 20 3252). The length of stem II may be ≧2 base-pairs.

TABLE V

Human KDR VEGF Receptor-Hairpin Ribozyme and Substrate Sequences

| nt. Position | Hairpin Ribozyme Sequence | Substrate |
|---|---|---|
| 11 | CGACGGCC AGAA GCACCU ACCAGAGAAACACACGUUGUGGUACAUUACCUGGUA | AGGUGCU GCU GGCCGUCG |
| 18 | CACAGGGC AGAA GCCAGC ACCAGAGAAACACACGUUGUGGUACAUUACCUGGUA | GCUGGCC GUC GCCCUGUG |
| 51 | CCCACAGA AGAA GCCCGG ACCAGAGAAACACACGUUGUGGUACAUUACCUGGUA | CCGGGCC GCC UCUGUGGG |
| 86 | UGAGCCUG AGAA GAUCAA ACCAGAGAAACACACGUUGUGGUACAUUACCUGGUA | UUGAUCU GCC CAGGCUCA |
| 318 | GAGGCCAA AGAA GUUUCC ACCAGAGAAACACACGUUGUGGUACAUUACCUGGUA | GGAAACU GAC UUGGCCUC |
| 358 | AAAUGGAG AGAA GUAAUC ACCAGAGAAACACACGUUGUGGUACAUUACCUGGUA | GAUUACA GAU CUCCAUUU |
| 510 | CUGUUACC AGAA GGAACA ACCAGAGAAACACACGUUGUGGUACAUUACCUGGUA | UGUUCCU GAU GGUAACAG |
| 623 | ACAUAAUA AGAA GGUAAC ACCAGAGAAACACACGUUGUGGUACAUUACCUGGUA | GUUACCA GUC UAUUAUGU |
| 683 | UUCCAUGA AGAA GACUCA ACCAGAGAAACACACGUUGUGGUACAUUACCUGGUA | UGAGUCC GUC UCAUGGAA |
| 705 | UUUUCUCC AGAA GAUAGU ACCAGAGAAACACACGUUGUGGUACAUUACCUGGUA | ACUAUCU GUU GGAGAAAA |
| 833 | CACUCCCA AGAA GGGUUU ACCAGAGAAACACACGUUGUGGUACAUUACCUGGUA | AAACCCA GUC UGGGAGUG |
| 932 | UCUUGGUC AGAA GCCCAC ACCAGAGAAACACACGUUGUGGUACAUUACCUGGUA | GUGGGCU GAU GACCAAGA |
| 1142 | CCAUAAUC AGAA GUACAU ACCAGAGAAACACACGUUGUGGUACAUUACCUGGUA | AUGUACU GAC GAUUAUGG |
| 1259 | UCUCACCA AGAA GGGGUG ACCAGAGAAACACACGUUGUGGUACAUUACCUGGUA | CACCCCA GAU UGGUGAGA |
| 1332 | AUGGCAUA AGAA GUACAU ACCAGAGAAACACACGUUGUGGUACAUUACCUGGUA | AUGUACG GUC UAUGCCAU |
| 1376 | CUUCCUCC AGAA GCCAAU ACCAGAGAAACACACGUUGUGGUACAUUACCUGGUA | AUUGGCA GUU GGAGGAAG |
| 1413 | GUCACUGA AGAA GGUUGG ACCAGAGAAACACACGUUGUGGUACAUUACCUGGUA | CCAAGCU GUC UCAGUGAC |
| 1569 | UUGUACAA AGAA GACACA ACCAGAGAAACACACGUUGUGGUACAUUACCUGGUA | UGUGUCA GCU UUGUACAA |
| 1673 | GCUCAGUG AGAA GCAUGU ACCAGAGAAACACACGUUGUGGUACAUUACCUGGUA | ACAUGCA GCC CACUGAGC |
| 1717 | AAACGUAG AGAA GUCUGC ACCAGAGAAACACACGUUGUGGUACAUUACCUGGUA | GCAGACA GAU CUACGUUU |
| 1760 | UUGGCAGA AGAA GUGGGC ACCAGAGAAACACACGUUGUGGUACAUUACCUGGUA | GCCCACA GCC UCUGCCAA |
| 1797 | UUCUUGCA AGAA GGUGUG ACCAGAGAAACACACGUUGUGGUACAUUACCUGGUA | CACACCU GUU UGCAAGAA |
| 1918 | UUGAGCAA AGAA GACAUA ACCAGAGAAACACACGUUGUGGUACAUUACCUGGUA | UAUGUCU GCC UUGCUCAA |
| 1967 | GGACUGUG AGAA GCCUGA ACCAGAGAAACACACGUUGUGGUACAUUACCUGGUA | UCAGGCA GCU CACAGUCC |
| 1974 | CGCUCUAG AGAA GUGAGC ACCAGAGAAACACACGUUGUGGUACAUUACCUGGUA | GCUCACA GUC CUAGAGCG |
| 2021 | UACUUGUC AGAA GAUUCU ACCAGAGAAACACACGUUGUGGUACAUUACCUGGUA | AGAAUCA GAC GACAAGUA |
| 2084 | ACCACAUG AGAA GUGGAG ACCAGAGAAACACACGUUGUGGUACAUUACCUGGUA | CUCCACA GAU CAUGUGGU |

TABLE V-continued

Human KDR VEGF Receptor-Hairpin Ribozyme and Substrate Sequences

| nt. Position | Hairpin Ribozyme Sequence | Substrate |
|---|---|---|
| 2418 | GGGAGUUC AGAA GGAUCC ACCAGAGAAACACACGUUGUGGUACAUUACCUGGUA | GCAUCCA GAU GAACUCCC |
| 2453 | CAUCAUAA AGAA GUCGUU ACCAGAGAAACACACGUUGUGGUACAUUACCUGGUA | AACGACU GCC UUAUGAUG |
| 2492 | CUAGGUUC AGAA GGUCUC ACCAGAGAAACACACGUUGUGGUACAUUACCUGGUA | GAGACCG GCU GAACCUAG |
| 2547 | CCAAAGGC AGAA GCUUCA ACCAGAGAAACACACGUUGUGGUACAUUACCUGGUA | UGAAGCA GAU GCCUUUGG |
| 2765 | GGUAAGUG AGAA GGUUUC ACCAGAGAAACACACGUUGUGGUACAUUACCUGGUA | GAAACCU GUC CACUUACC |
| 2914 | AAAUCCAG AGAA GGCUGA ACCAGAGAAACACACGUUGUGGUACAUUACCUGGUA | UCAGCCA GCU CUGGAUUU |
| 2993 | GCUCCAAG AGAA GGAAGU ACCAGAGAAACACACGUUGUGGUACAUUACCUGGUA | ACUUCCU GAC CUUGGAGC |
| 3019 | CACUUGGA AGAA GUAACA ACCAGAGAAACACACGUUGUGGUACAUUACCUGGUA | UGUUACA GCU UCCAAGUG |
| 3165 | CUGACAUA AGAA GGAUCU ACCAGAGAAACACACGUUGUGGUACAUUACCUGGUA | AGAUCCA GAU UAUGUCAG |
| 3378 | GUAGUAUA AGAA GGGGCC ACCAGAGAAACACACGUUGUGGUACAUUACCUGGUA | GGCCCCU GAU UAUACUAC |
| 3404 | CCAGCAUG AGAA GGUACA ACCAGAGAAACACACGUUGUGGUACAUUACCUGGUA | UGUACCA GAC CAUGCUGG |
| 3418 | CCCGUGCC AGAA GUCCAG ACCAGAGAAACACACGUUGUGGUACAUUACCUGGUA | CUGGACU GCU GGCACGGG |
| 3575 | GUGAGGUA AGAA GAGAGA ACCAGAGAAACACACGUUGUGGUACAUUACCUGGUA | UCUCUCU GCC UACCUCAC |
| 3588 | AUACAGGA AGAA GGUGAG ACCAGAGAAACACACGUUGUGGUACAUUACCUGGUA | CUCACCU GUU UCCUGUAU |
| 3689 | CACUCACA AGAA GGCUCU ACCAGAGAAACACACGUUGUGGUACAUUACCUGGUA | AGAGCCG GCC UGUGAGUG |
| 3753 | UGGUUGUC AGAA GGGAUU ACCAGAGAAACACACGUUGUGGUACAUUACCUGGUA | AAUCCCA GAU GACAACCA |
| 3764 | CACUGUCC AGAA GGUUGU ACCAGAGAAACACACGUUGUGGUACAUUACCUGGUA | ACAACCA GAC GGACAGUG |
| 3911 | GAUAUCCG AGAA GGUAGC ACCAGAGAAACACACGUUGUGGUACAUUACCUGGUA | GCUACCA GUC CGGAUAUC |
| 3927 | UCUGUGUC AGAA GAGUGA ACCAGAGAAACACACGUUGUGGUACAUUACCUGGUA | UCACUCC GAU GACACAGA |
| 4011 | AGAAUCUG AGAA GUGCUA ACCAGAGAAACACACGUUGUGGUACAUUACCUGGUA | UAGCACA GCC CAGAUUCU |
| 4016 | GCUGGAGA AGAA GGGCUG ACCAGAGAAACACACGUUGUGGUACAUUACCUGGUA | CAGCCCA GAU UCUCCAGC |
| 4025 | CCGUGUCA AGAA GGAGAA ACCAGAGAAACACACGUUGUGGUACAUUACCUGGUA | UUCUCCA GCC UGACACGG |
| 4059 | UCCUUUUA AGAA GGAGGA ACCAGAGAAACACACGUUGUGGUACAUUACCUGGUA | UCCUCCU GUU UAAAAGGA |
| 4111 | AAAAUCUG AGAA GACCUC ACCAGAGAAACACACGUUGUGGUACAUUACCUGGUA | GAGGUCU GCU CAGAUUUU |
| 4116 | ACUUCAAA AGAA GAGGAG ACCAGAGAAACACACGUUGUGGUACAUUACCUGGUA | CUGCUCA GAU UUUGAAGU |
| 4195 | UCCCUGCA AGAA GAGGUC ACCAGAGAAACACACGUUGUGGUACAUUACCUGGUA | GACCUCG GAC UGCAGGGA |
| 4210 | CCUAGAAG AGAA GGCUCC ACCAGAGAAACACACGUUGUGGUACAUUACCUGGUA | GGAGCCA GCU CUUCUAGG |

TABLE VI

Mouse flk-1 VEGF Receptor-Hammerhead Ribozyme and Substrate sequence

| nt. Position | HH Ribozyme Sequence | Substrate |
|---|---|---|
| 13 | CCGUACCC CUGAUGA X GAA AUUCGCCC | GGGCGAAUU GGGUACGG |
| 18 | GGGUCCCG CUGAUGA X GAA ACCCAAUU | AAUUGGGUA CGGGACCC |
| 31 | UCGACCUC CUGAUGA X GAA AGGGGGGU | ACCCCCUC GAGGUCGA |
| 37 | AUACCGUC CUGAUGA X GAA ACCUqGAG | CUCGAGGUC GACGGUAU |
| 44 | CUUAUCGA CUGAUGA X GAA ACCGUCGA | UCGACGGUA UCCAUAAG |

TABLE VI-continued

Mouse flk-1 VEGF Receptor-Hammerhead Ribozyme and Substrate sequence

| nt. Position | HH Ribozyme Sequence | Substrate |
|---|---|---|
| 46 | AGCUUAUC CUGAUGA X GAA AUACCGUC | GACGGUAUC GAUAAGCU |
| 50 | AUCAAGCU CUGAUGA X GAA AUCGAUAC | GUAUCGAUA AGCUUGAU |
| 55 | UCGAUAUC CUGAUGA X GAA AGCUUAUC | GAUAAGCUU GAUAUCGA |
| 59 | GAAUUCGA CUGAUGA X GAA AUCAAGCU | AGCUUGAUA UCGAAUUC |
| 61 | CCGAAUUC CUGAUGA X GAA AUAUCAAG | CUUGAUAUC GAAUUCGG |
| 66 | UGGGCCCG CUGAUGA X GAA AUUCGAUA | UAUCGAAUU CGGGCCCA |
| 67 | CUGGGCCC CUGAUGA X GAA AAUUCGAU | AUCGAAUUC GGGCCCAG |
| 83 | GGCUGCGG CUGAUGA X GAA ACACAGUC | GACUGUGUC CCGCAGCC |
| 97 | AGCCAGGU CUGAUGA X GAA AUCCCGGC | GCCGGGAUA ACCUGGCU |
| 114 | GUCCGCGG CUGAUGA X GAA AUCGGGUC | GACCCGAUU CCGCGGAC |
| 115 | UGUCCGCG CUGAUGA X GAA AAUCGGGU | ACCCGAUUC CGCGGACA |
| 169 | ACCGGGGA CUGAUGA X GAA AGCGCGGG | CCCGCGCUC UCCCCGGU |
| 171 | AGACCGGG CUGAUGA X GAA AGAGCGCG | CGCGCUCUC CCCGGUCU |
| 178 | CAGCGCAA CUGAUGA X GAA ACCGGGGA | UCCCCGGUC UUGCGCUG |
| 180 | CGCAGCGC CUGAUGA X GAA AGACCGGG | CCCGGUCUU GCGCUGCG |
| 197 | AGAGGCGG CUGAUGA X GAA AUGGCCCC | GGGGCCAUA CCGCCUCU |
| 204 | AAGUCACA CUGAUGA X GAA AGGCGGUA | UACCGCCUC UGUGACUU |
| 212 | CCGCAAAG CUGAUGA X GAA AGUCACAG | CUGUGACUU CUUUGCGG |
| 213 | CCCGCAAA CUGAUGA X GAA AAGUCACA | UGUGACUUC UUUGCGGG |
| 215 | GGCCCGCA CUGAUGA X GAA AGAAGUCA | UGACUUCUU UGCGGGCC |
| 216 | UGGCCCGC CUGAUGA X GAA AAGAAGUC | GACUUCUUU GCGGGCCA |
| 241 | CAGGCACA CUGAUGA X GAA ACUCCUUC | GAAGGAGUC UGUGCCUG |
| 262 | UGGGCACA CUGAUGA X GAA AGCCCAGU | ACUGGGCUC UGUGCCCA |
| 306 | GCGACAGC CUGAUGA X GAA AGCAGCGC | GCGCUGCUA GCUGUCGC |
| 312 | CACAGAGC CUGAUGA X GAA ACAGCUAG | CUAGCUGUC GCUCUGUG |
| 316 | GAACCACA CUGAUGA X GAA AGCGACAG | CUGUCGCUC UGUGGUUC |
| 323 | CCACGCGG CUGAUGA X GAA ACCACAGA | UCUGUGGUU CUGCGUGG |
| 324 | UCCACGCA CUGAUGA X GAA AACCACAG | CUGUGGUUC UGGGUGGA |
| 347 | AACCCACA CUGAUGA X GAA AGGCGGCU | AGCCGCCUC UGUGGGUU |
| 355 | GCCAGUCA CUGAUGA X GAA ACCCACAG | CUGUGGGUU UGACUGGC |
| 356 | CGCCAGUC CUGAUGA X GAA AACCCACA | UGUGGGUUU GACUGGCG |
| 367 | AUGGAGAA CUGAUGA X GAA AUCGCCAG | CUGGCGAUU UUCUCCAU |
| 368 | GAUGGAGA CUGAUGA X GAA AAUCGCCA | UGGCGAUUU UCUCCAUC |
| 369 | GGAUGGAG CUGAUGA X GAA AAAUCGCC | GGCGAUUUU CUCCAUCC |
| 370 | GGGAUGGA CUGAUGA X GAA AAAAUCGC | GCGAUUUUC UCCAUCCC |
| 372 | GGGGGAUG CUGAUGA X GAA AGAAAAUC | GAUUUUCUC CAUCCCCC |
| 376 | CUGGGGGG CUGAUGA X GAA AUGGAGAA | UUCUCCAUC CCCCAAG |

TABLE VI-continued

Mouse flk-1 VEGF Receptor-Hammerhead Ribozyme and Substrate sequence

| nt. Position | HH Ribozyme Sequence | Substrate |
|---|---|---|
| 387 | UGUGUGCU CUGAUGA X GAA AGCUUGGG | CCCAAGCUC AGCACACA |
| 405 | AUUGUCAG CUGAUGA X GAA AUGUCUUU | AAAGACAUA CUGACAAU |
| 414 | UUUGCCAA CUGAUGA X GAA AUGGUCAG | CUGACAAUU UUGGCAAA |
| 415 | AUUUGCCA CUGAUGA X GAA AAUUGUCA | UGACAAUUU UGGCAAAU |
| 416 | UAUUUGCC CUGAUGA X GAA AAAUUGUC | GACAAUUUU GGCAAAUA |
| 424 | AAGGGUUG CUGAUGA X GAA AUUUGCCA | UGGCAAAUA CAACCCUU |
| 432 | GUAAUCUG CUGAUGA X GAA ACGGUUGU | ACAACCCUU CAGAUUAC |
| 433 | AGUAAUCU CUGAUGA X GAA AAGGGUUG | CAACCCUUC AGAUUACU |
| 438 | CUGCAAGU CUGAUGA X GAA AUCUGAAG | CUUCAGAUU ACUUGCAG |
| 439 | CCUGCAAG CUGAUGA X GAA AAUCUGAA | UUCAGAUUA CUUGCAGG |
| 442 | UCCCCUGC CUGAUGA X GAA AGUAAUCU | AGAUUACUU GCAGGGGA |
| 471 | UUGGGCCA CUGAUGA X GAA AGCCAGUC | GACUGGCUU UGGCCCAA |
| 472 | AUGGGCC CUGAUGA X GAA AAGCCAGU | ACUGGCUUU GGCCCAAU |
| 484 | AUCACGCU CUGAUGA X GAA AGCAUUGG | CCAAUGCUC AGCGUGAU |
| 493 | UUCCUCAG CUGAUGA X GAA AUCACGCU | AGCGUGAUU CUGACGAA |
| 494 | UUUCCUCA CUGAUGA X GAA AAUCACGC | GCGUGAUUC UGAGGAAA |
| 507 | GUCACCAA CUGAUGA X GAA ACCCUUUC | GAAAGGGUA UUGGUGAC |
| 509 | CAGUCACC CUGAUGA X GAA AUACCCUU | AAGGGUAUU GGUGACUG |
| 538 | GCAGAAGA CUGAUGA X GAA ACUGUCAC | GUGACAGUA UCUUCUGC |
| 540 | UUGCAGAA CUGAUGA X GAA AUACUGUC | GACAGUAUC UUCUGCAA |
| 542 | UUUUGCAG CUGAUGA X GAA AGAUACUG | CAGUAUCUU CUGCAAAA |
| 543 | GUUUUGCA CUGAUGA X GAA AAGAUACU | AGUAUCUUC UGGAAAAC |
| 555 | GGAAUGGU CUGAUGA X GAA AGUGUUUU | AAAACACUC ACCAUUCC |
| 561 | ACCCUGGG CUGAUGA X GAA AUGGUGAG | CUCACCAUU CCCAGGGU |
| 562 | CACCCUGG CUGAUGA X GAA AAUGGUGA | UCACCAUUC CCAGGGUG |
| 573 | UCAUUUCC CUGAUGA X GAA ACCACCCU | AGGGUGGUU GGAAAUGA |
| 583 | GGCUCCAG CUGAUGA X GAA AUCAUUUC | GAAAUGAUA CUGGAGCC |
| 593 | AGCACUUG CUGAUGA X GAA AGGCUCCA | UGGAGCCUA CAAGUGCU |
| 602 | CCCGGUAC CUGAUGA X GAA AGCACUUG | CAAGUGCUC GUACCGGG |
| 605 | CGUCCGG CUGAUGA X GAA ACGAGCAC | GUGCUCGUA CCGGGACG |
| 615 | GCUAUGUC CUGAUGA X GAA ACGUCCCG | CGGGACGUC GACAUAGC |
| 621 | GUGGAGGC CUGAUGA X GAA AUGUCGAC | GUCGACAUA GCCUCCAC |
| 626 | AAACAGUG CUGAUGA X CAA AGGCUAUG | CAUAGCCUC CACUGUUU |
| 633 | UAGACAUA CUGAUGA X GAA ACAGUGGA | UCCACUGUU UAUGUCUA |
| 634 | AUAGACAU CUGAUGA X GAA AACAGUGG | CCACUGUUU AUGUCUAU |
| 635 | CAUAGACA CUGAUGA X GAA AAACAGUG | CACUGUUUA UGUCUAUG |
| 639 | CGAACAUA CUGAUGA X GAA ACAUAAAC | GUUUAUGUC UAUGUUCG |

TABLE VI-continued

Mouse flk-1 VEGF Receptor-Hammerhead Ribozyme and Substrate sequence

| nt. Position | HH Ribozyme Sequence | Substrate |
|---|---|---|
| 641 | CUCGAACA CUGAUGA X GAA AGACAUAA | UUAUGUCUA UGUUCGAG |
| 645 | UAAUCUCG CUGAUGA X GAA ACAUAGAC | GUCUAUGUU CGAGAUUA |
| 646 | GUAAUCUC CUGAUGA X GAA AACAUAGA | UCUAUGUUC GAGAUUAC |
| 652 | UGAUCUGU CUGAUGA X GAA AUCUCGAA | UUCGAGAUU ACAGAUCA |
| 653 | GUGAUCUG CUGAUGA X GAA AAUCUCGA | UCGAGAUUA CAGAUCAC |
| 659 | UGAAUGGU CUGAUGA X GAA AUCUGUAA | UUACAGAUC ACCAUUCA |
| 665 | AGGCGAUG CUGAUGA X GAA AUGGUGAU | AUCACCAUU CAUCGCCU |
| 666 | GAGGCGAU CUGAUGA X GAA AAUGGUGA | UCACCAUUC AUCGCCUC |
| 669 | ACAGAGGC CUGAUGA X GAA AUGAAUGG | CCAUUCAUC GCCUCUGU |
| 674 | CACUGACA CUGAUGA X GAA AGGCGAUG | CAUCGCCUC UGUCAGUG |
| 678 | UGGUCACU CUGAUGA X GAA ACAGAGGC | GCCUCGGUC AGUGACCA |
| 696 | AUGUACAC CUGAUGA X GAA AUGCCAUG | CAUGGCAUC GUGUACAU |
| 701 | CGGUGAUG CUGAUGA X GAA ACACGAUG | CAUCGUGUA CAUCACCG |
| 705 | UUCUCGGU CUGAUGA X GAA AUGUACAC | GUGUACAUC ACCGAGAA |
| 735 | CGGCAGGG CUGAUGA X GAA AUCACCAC | GUGGUGAUC CCCUGCCG |
| 749 | UUGAAAUC CUGAUGA X GAA ACCCUCGG | CCGAGGGUC GAUUUCAA |
| 753 | AGGUUUGA CUGAUGA X GAA AUCGACCC | GGGUCGAUU UCAAACCU |
| 754 | GAGGUUUG CUGAUGA X GAA AAUCGACC | GGUCGAUUU CAAACCUC |
| 755 | UGAGGUUU CUGAUGA X GAA AAAUCGAC | GUCGAUUUC AAACCUCA |
| 762 | GACACAUU CUGAUGA X GAA AGGUUUGA | UCAAACCUC AAUGUGUC |
| 770 | CGCAAAGA CUGAUGA X GAA ACACAUUG | CAAUGUGUC UCUUUGCG |
| 772 | AGCGCAAA CUGAUGA X GAA AGACACAU | AUGUGUCUC UUUGCGCU |
| 774 | CUAGCGCA CUGAUGA X GAA AGAGACAC | GUGUCUCUU UGCGCUAG |
| 775 | CCUAGCGC CUGAUGA X GAA AAGAGACA | UGUCUCUUU GCGCUAGG |
| 781 | UGGAUACC CUGAUGA X GAA AGCGCAAA | UUUGCGCUA GGUAUCCA |
| 785 | UUUCUGGA CUGAUGA X GAA ACCUAGCG | CGCUAGGUA UCCAGAAA |
| 787 | CUUUUCUG CUGAUGA X GAA AUACCUAG | CUAGGUAUC CAGAAAAG |
| 800 | CCGGAACA CUGAUGA X GAA AUCUCUUU | AAAGAGAUU UGUUCCGG |
| 801 | UCCGGAAC CUGAUGA X GAA AAUCUCUU | AAGAGAUUU GUUCCGGA |
| 804 | CCAUCCGG CUGAUGA X GAA ACAAAUCU | AGAUUUGUU CCGGAUGG |
| 805 | UCCAUCCG CUGAUGA X GAA AACAAAUC | GAUUUGUUC CGGAUGGA |
| 822 | UCCCAGGA CUGAUGA X GAA AUUCUGUU | AAGAGAAUU UCCUGGGA |
| 823 | GUCCCAGG CUGAUGA X GAA AAUUCUGU | ACAGAAUUU CCUGGGAC |
| 824 | UGUCCCAG CUGAUGA X GAA AAAUUCUG | CAGAAUUUC CUGGGACA |
| 840 | GUAAAGCC CUGAUGA X GAA AUCUCGCU | AGCGAGAUA GGCUUUAC |
| 845 | GGAGAGUA CUGAUGA X GAA AGCCUAUC | GAUAGGCUU UACUCUCC |
| 846 | GGGAGAGU CUGAUGA X GAA AAGCCUAU | AUAGGCUUU ACUCUCCC |

TABLE VI-continued

Mouse flk-1 VEGF Receptor-Hammerhead Ribozyme and Substrate sequence

| nt. Position | HH Ribozyme Sequence | Substrate |
|---|---|---|
| 847 | GGGGAGAG CUGAUGA X GAA AAAGCCUA | UACGCUUUA CUCUCCCC |
| 850 | ACUGGGGA CUGAUGA X GAA AGUAAAGC | GCUUUACUC UCCCCAGU |
| 852 | UAACUGGG CUGAUGA X GAA AGAGUAAA | UUUACUCUC CCCAGUUA |
| 859 | GAUCAUGU CUGAUGA X GAA ACUGGGGA | UCCCCAGUU ACAUGAUC |
| 860 | UGAUCAUG CUGAUGA X GAA AACUGGGG | CCCCAGUUA CAUGAUCA |
| 867 | GCAUAGCU CUGAUGA X GAA AUCAUGUA | UACAUGAUC AGCUAUGC |
| 872 | UGCCGGCA CUGAUGA X GAA AGCUGAUC | GAUCAGCUA UGCCGGCA |
| 885 | UCACAGAA CUGAUGA X GAA ACCAUGCC | GGCAUGGUC UUCUGUGA |
| 887 | CCUCACAG CUGAUGA X GAA AGACCAUG | CAUGGUCUU CUGUGAGG |
| 888 | GCCUCACA CUGAUGA X GAA AAGACCAU | AUGGUCUUC UGUGAGGC |
| 903 | UCAUCAUU CUGAUGA X GAA AUCUUUGC | GCAAAGAUC AAUGAUGA |
| 917 | UAGACUGA CUGAUGA X GAA AGGUUUCA | UGAAACCUA UCAGUCUA |
| 919 | GAUAGACU CUGAUGA X GAA AUAGGUUU | AAACCUAUC AGUCUAUC |
| 923 | ACAUGAUA CUGAUGA X GAA ACUGAUAG | CUAUCAGUC UAUCAUGU |
| 925 | GUACAUGA CUGAUGA X GAA AGACUGAU | AUCAGUCUA UCAUGUAC |
| 927 | AUGUACAU CUGAUGA X GAA AUAGACUG | CAGUCUAUC AUGUACAU |
| 932 | CAACUAUG CUGAUGA X GAA ACAUGAUA | UAUCAUGUA CAUAGUUG |
| 936 | ACCACAAC CUGAUGA X GAA AUGUACAU | AUGUACAUA GUUGUGGU |
| 939 | ACAACCAC CUGAUGA X GAA ACUAUGUA | UACAUAGUU GUGGUUGU |
| 945 | UAUCCUAC CUGAUGA X GAA ACCACAAC | GUUGUGGUU GUAGGAUA |
| 948 | CUAUAUCC CUGAUGA X GAA ACAACCAC | GUGGUUGUA GGAUAUAG |
| 953 | AAAUCCUA CUGAUGA X GAA AUCCUACA | UGUAGGAUA UAGGAUUU |
| 955 | AUAAAUCC CUGAUGA X GAA AUAUCCUA | UAGGAUAUA GGAUUUAU |
| 960 | ACAUCAUA CUGAUGA X GAA AUCCUAUA | UAUAGGAUU UAUGAUGU |
| 961 | CACAUCAU CUGAUGA X GAA AAUCCUAU | AUAGGAUUU AUGAUGUG |
| 962 | UCACAUCA CUGAUGA X GAA AAAUCCUA | UAGGAUUUA UGAUGUGA |
| 972 | GGGCUCAG CUGAUGA X GAA AUCACAUC | GAUGUGAUU CUGAGCCC |
| 973 | GGGGCUCA CUGAUGA X GAA AAUCACAU | AUGUGAUUC UGAGCCCC |
| 993 | GAUAGCUC CUGAUGA X GAA AUUUCAUG | CAUGAAAUU GAGCUAUC |
| 999 | CCGGCAGA CUGAUGA X GAA AGCUCAAU | AUUGAGCUA UCUGCCGG |
| 1001 | CUCCGGCA CUGAUGA X GAA AUAGCUCA | UGAGCUAUC UGCCGGAG |
| 1017 | UUUAAGAC CUGAUGA X GAA AGUUUUUC | GAAAACUU GUCUUAAA |
| 1020 | CAAUUUAA CUGAUGA X GAA ACAAGUUU | AAACUUGUC UUAAAUUG |
| 1022 | UACAAUUU CUGAUGA X GAA AGACAAGU | ACUUGUCUU AAAUUUGA |
| 1023 | GUACAAUU CUGAUGA X GAA AAGACAAG | CUUGUCUUA AAUUGUAC |
| 1027 | CGCUGUAC CUGAUGA X GAA AUUUAAGA | UCUUAAAUU GUACCGCG |
| 1030 | UCUCGCUG CUGAUGA X GAA ACAAUUUA | UAAAUUGUA CAGCGAGA |

TABLE VI-continued

Mouse flk-1 VEGF Receptor-Hammerhead Ribozyme and Substrate sequence

| nt. Position | HH Ribozyme Sequence | Substrate |
|---|---|---|
| 1047 | CCCACAUU CUGAUGA X GAA AGCUCUGU | ACAGAGCUC AAUGUGGG |
| 1059 | GUGAAAUC CUGAUGA X GAA AGCCCCAC | GUGGGGGUU GAUUUCAC |
| 1063 | CCAGGUGA CUGAUGA X GAA AUCAAGCC | GGCUUGAUU UCACCUGG |
| 1064 | GCCAGGUG CUGAUGA X GAA AAUCAAGC | GCUUGAUUU CACCUGGC |
| 1065 | UGCCAGGU CUGAUGA X GAA AAAUCAAG | CUUGAUUUC ACCUGGCA |
| 1076 | AAGGUGGA CUGAUGA X GAA AGUGCCAG | CUGGCACUC UCCACCUU |
| 1078 | UGAAGGUG CUGAUGA X GAA AGAGUGCC | GGCACUCUC CACCUUCA |
| 1084 | AGACUUUG CUGAUGA X GAA AGGUGGAG | CUCCACCUU CAAAGUCU |
| 1085 | GAGACUUU CUGAUGA X GAA AAGGUGGA | UCCACCUUC AAAGUCUC |
| 1091 | UAUGAUGA CUGAUGA X GAA ACUUUGAA | UUCAAAGUC UCAUCAUA |
| 1093 | CUUAUGAU CUGAUGA X GAA AGACUUUG | CAAAGUCUC AUCAUAAG |
| 1096 | CUUCUUAU CUGAUGA X GAA AUGAGACU | AGUCUCAUC AUAAGAAG |
| 1099 | AAUCUUCU CUGAUGA X GAA AUGAUGAG | CUCAUCAUA AGAAGAUU |
| 1107 | CGGUUUAC CUGAUGA X GAA AUCUUCUU | AAGAAGAUU GUAAACCG |
| 1110 | UCCCGGUU CUGAUGA X GAA ACAAUCUU | AAGAUUGUA AACCGGGA |
| 1130 | UCCCAGGA CUGAUGA X GAA AGGGUUUC | GAAACCCUU UCCUGGGA |
| 1131 | GUCCAGG CUGAUGA X GAA AAGGGUUU | AAACCCUUU CCUGGGAC |
| 1132 | AGUCCCAG CUGAUGA X GAA AAAGGGUU | AACCCUUUC CUGGGACU |
| 1154 | UGCUCAAA CUGAUGA X GAA ACAUCUUC | GAAGAUGUU UUUGAGCA |
| 1155 | GUGCUCAA CUGAUGA X GAA AACAUCUU | AAGAUGUUU UUGAGCAC |
| 1156 | GGUGCUCA CUGAUGA X GAA AAACAUCU | AGAUGUUUU UGAGCACC |
| 1157 | AGGUGCUC CUGAUGA X GAA AAAACAUC | GAUGUUUUU GAGCACCU |
| 1166 | CUAUUGUC CUGAUGA X GAA AGGUGCUC | GAGCACCUU ACAAUAG |
| 1173 | ACACUUUC CUGAUGA X GAA AUUGUCAA | UUGAGAAUA GAAAGUGU |
| 1205 | CACAGGUG CUGAUGA X GAA AUUCCCCU | AGGGGAAUA CACCUGUG |
| 1215 | CUGGACGC CUGAUGA X GAA ACACAGGU | ACCUGUGUA GCGUCCAG |
| 1220 | GUCCACUG CUGAUGA X GAA ACGCUACA | UGUAGCGUC CAGUGGAC |
| 1236 | UUUCUCUU CUGAUGA X GAA AUCAUCCG | CGGAUGAUC AAGAGAAA |
| 1246 | AAAUGUUC CUGAUGA X GAA AUUUCUCU | AGAGAAAUA GAACAUUU |
| 1253 | CUCGGACA CUGAUGA X GAA AUGUUCUA | UAGAACAUU UGUCCGAG |
| 1254 | ACUCGGAC CUGAUGA X GAA AAUGUUCU | AGAACAUUU GUCCGAGU |
| 1257 | UGAACUCG CUGAUGA X GAA ACAAAUGU | ACAUUUGUC CGAGUUCA |
| 1263 | UUUGUGUG CUGAUGA X GAA ACUCGGAC | GUCCGAGUU CACACAAA |
| 1264 | CUUUGUGU CUGAUGA X GAA AACUCGGA | UCCGAGUUC ACACAAAG |
| 1276 | AGCAAUAA CUGAUGA X GAA AGGCUUUG | CAAAGCCUU UUAUUGCU |
| 1277 | AAGCAAUA CUGAUGA X GAA AAGGCUUU | AAAGCCUUU UAUUGCUU |
| 1278 | AAAGAAAU CUGAUGA X GAA AAAGGCUU | AAGCCUUUU AUUGCUUU |

TABLE VI-continued

Mouse flk-1 VEGF Receptor-Hammerhead Ribozyme and Substrate sequence

| nt. Position | HH Ribozyme Sequence | Substrate |
|---|---|---|
| 1279 | GAAAGCAA CUGAUGA X GAA AAAAGGCU | AGCCUUUUA UUGCUUUC |
| 1281 | CCGAAAGC CUGAUGA X GAA AUAAAAGG | CCUUUUAUU GCUUUCGG |
| 1285 | ACUACCGA CUGAUGA X GAA AGCAAUAA | UUAUUGCUU UCGGUAGU |
| 1286 | CACUACCG CUGAUGA X GAA AAGCAAUA | UAUUGCUUU CGGUAGUG |
| 1287 | CCACUACC CUGAUGA X GAA AAAGCAAU | AUUGCUUUC GGGAGUGG |
| 1291 | CAUCCCAC CUGAUGA X GAA ACCGAAAG | CUUUCGGUA GUGGGAUG |
| 1304 | CCACCAAA CUGAUGA X GAA AUUUCAUC | GAUGAAAUC UUUGGUGG |
| 1306 | UUCCACCA CUGAUGA X GAA AGAUUUCA | UGAAAUCUU UGGUGGAA |
| 1307 | CUUCCACC CUGAUGA X GAA AAGAUUUC | GAAAUCUUU GGUGGAAG |
| 1330 | UCGGACUU CUGAUGA X GAA ACUGCCCA | UGGGCAGUC AAGUCCGA |
| 1335 | GGGAUUCG CUGAUGA X GAA ACUUGACU | AGUCAAGUC CGAAUCCC |
| 1341 | UUCACAGG CUGAUGA X GAA AUUCGGAC | GUCCGAAUC CUGUGAA |
| 1352 | AACUGAGA CUGAUGA X GAA ACUUCACA | UGUGAAGUA UCUCAGUU |
| 1354 | GUAACUGA CUGAUGA X GAA AUACUUCA | UGAAGUAUC UCAGUUAC |
| 1356 | GGGUAACU CUGAUGA X GAA AGAUACUU | AAGUAUCUC AGUUACCC |
| 1360 | AGCUGGGU CUGAUGA X GAA ACUGAGAU | AUCUCAGUU ACCCAGCU |
| 1361 | GAGCUGGG CUGAUGA X GAA AACUGAGA | UCUCAGUUA CCCAGCUC |
| 1369 | GAUAUGAG CUGAUGA X GAA AGCUGGGU | ACCCAGCUC CUGAUAUC |
| 1375 | CCAUUUGA CUGAUGA X GAA AUCAGGAG | CUCCUGAUA UCAAAUGG |
| 1377 | UACCAUUU CUGAUGA X GAA AUAUCAGG | CCUGAUAUC AAAUGGUA |
| 1385 | CAUUUCUG CUGAUGA X GAA ACCAUUUG | CAAAUGGUA CAGAAAUG |
| 1404 | UUGGACUC CUGAUGA X GAA AUCGGCCU | AGGCCAUU GAGUCCAA |
| 1409 | UGUAGUUG CUGAUGA X GAA ACUCAAUG | CAUUGAGUC CAACUACA |
| 1415 | UCAUUGUG CUGAUGA X GAA AGUUGGAC | GUCCAACUA CACAAUGA |
| 1425 | UCGCCAAC CUGAUGA X GAA AUCAUUGU | ACAAUGAUU GUUGGCGA |
| 1428 | UCAUCGCC CUGAUGA X GAA ACAAUCAU | AUGAUUCUU GGCGAUGA |
| 1440 | AUGAUGGU CUGAUGA X GAA AGUUCAUC | GAUGAACUC ACCAUCAU |
| 1446 | ACUUCCAU CUGAUGA X GAA AUGGUGAG | CUCACCAUC AUGGAAGU |
| 1478 | UGACCGUG CUGAUGA X GAA AGUUUCCU | AGGAAACUA CACGGUCA |
| 1485 | GUGAGGAU CUGAUGA X GAA ACCGUGUA | UACACGGUC AUCCUCAC |
| 1488 | UUGGUGAG CUGAUGA X GAA AUGACCGU | ACGGUCAUC CUCACCAA |
| 1491 | GGGUUGGU CUGAUGA X GAA AGGAUGAC | GUCAUCCUC ACCAACCC |
| 1503 | UCCAUUGA CUGAUGA X GAA AUGGGGUU | AACCCCAUU CAAUGGA |
| 1504 | CUCCAUUG CUGAUGA X GAA AAUGGGGU | ACCCCAUUU CAAUGGAG |
| 1505 | UCUCCAUU CUGAUGA X GAA AAAUGGGG | CCCCAUUUC AAUGCAGA |
| 1530 | ACCAGAGA CUGAUGA X GAA ACCAUGUG | CACAUGGUC UCUCUGGU |
| 1532 | CAACCAGA CUGAUGA X GAA AGACCAUG | CAUGGUCUC UCUGGUUG |

TABLE VI-continued

Mouse flk-1 VEGF Receptor-Hammerhead Ribozyme and Substrate sequence

| nt. Position | HH Ribozyme Sequence | Substrate |
|---|---|---|
| 1534 | CACAACCA CUGAUGA X GAA AGAGACCA | UGGUCUCUC UGGUUGUG |
| 1539 | ACAUUCAC CUGAUGA X GAA ACCAGAGA | UCUCUGGUU GUGAAUGU |
| 1548 | UGGGGUGG CUGAUGA X GAA ACAUUCAC | GUGAAUGUC CCACCCCA |
| 1560 | UUCUCACC CUGAUGA X GAA AUCUGGGG | CCCCAGAUC GGUGAGAA |
| 1574 | GCGAGAUC CUGAUGA X GAA AGGCUUUC | GAAAGCCUU GAUCUCGC |
| 1578 | AUAGGCGA CUGAUGA X GAA AUCAAGGC | GCCUUGAUC UCGCCUAU |
| 1580 | CCAUAGGC CUGAUGA X GAA AGAUCAAG | CUUGAUCUC GCCUAUGG |
| 1585 | GGAAUCCA CUGAUGA X GAA AGGCGAGA | UCUCGCCUA UGGAUUCC |
| 1591 | CUGGUAGG CUGAUGA X GAA AUCCAUAG | CUAUGGAUU CCUACCAG |
| 1592 | ACUGGUAG CUGAUGA X GAA AAUCCAUA | UAUGGAUUC CUACCACU |
| 1595 | CAUACUGG CUGAUGA X GAA AGGAAUCC | GGAUUCCUA CCAGUAUG |
| 1601 | UGGUCCCA CUGAUGA X GAA ACUGGUAG | CUACCAGUA UGGGACCA |
| 1619 | UGCAUGUC CUGAUGA X GAA AUGUCUGC | GCAGACAUU GACAUGCA |
| 1632 | UUGGCGUA CUGAUGA X GAA ACUGUGCA | UGCACAGUC UACGCCAA |
| 1634 | GGUUGGCG CUGAUGA X GAA AGACUGUG | CACAGUCUA CGCCAACC |
| 1645 | GUGCAGGG CUGAUGA X GAA AGGGUUGG | CCAACCCUC CCCUGCAC |
| 1659 | UACCACUG CUGAUGA X GAA AUGUGGUG | CACCACAUC CAGUGGGA |
| 1667 | GCUGCCAG CUGAUGA X GAA ACCACUGG | CCAGUGGUA CUGGCAGC |
| 1677 | GCUUCUUC CUGAUGA X GAA AGCUGCCA | UGGCAGCUA GAAGAAGC |
| 1691 | GUCUGUAG CUGAUGA X GAA AGCAGGCU | AGCCUGCUC CUACAGAC |
| 1694 | CGGGUCUG CUGAUGA X GAA AGGAGCAG | CUGCUCCUA CAGACCCG |
| 1718 | UACAAGCA CUGAUGA X GAA ACGGGCUU | AAGCCCGUA UGCUUGUA |
| 1723 | UUCUUUAC CUGAUGA X rAA AGCAUACG | CGUAUGCUU GUAAAGAA |
| 1726 | CCAUUCUU CUGAUGA X GAA ACAAGCAU | AUGCUUGUA AAGAAUGG |
| 1750 | CCCCUGGA CUGAUGA X GAA AUCCUCCA | UGGAGGAUU UCCAGGGG |
| 1751 | CCCCCUGG CUGAUGA X GAA AAUCCUCC | GGAGGAUUU CCAGGGGG |
| 1752 | CCCCCCUG CUGAUGA X GAA AAAUCCUC | GAGGAUUUC CAGGGGGG |
| 1770 | GUGACUUC CUGAUGA X GAA AUCUUGUU | AACAAGAUC GAAGUCAC |
| 1776 | UUUUUGGU CUGAUGA X GAA ACUUCGAU | AUCGAAGUC ACCAAAAA |
| 1790 | UCAGGGCA CUGAUGA X GAA AUUGGUUU | AAACCAAUA UGCCCUGA |
| 1800 | UUUCCUUC CUGAUGA X GAA AUCAGGGC | GCCCUGAUU GAAGGAAA |
| 1821 | AGCGUACU CUGAUGA X GAA ACAGUUUU | AAAACUGUA AGUACGCU |
| 1825 | GACCAGCG CUGAUGA X GAA ACUUACAG | CUGUAAGUA CGCUGGUC |
| 1833 | GCUUGGAU CUGAUGA X GAA ACCAGCGU | ACGCUGGUC AUCCAAGC |
| 1836 | GCAGCUUG CUGAUGA X GAA AUGACCAG | CUGGUCAUC CAAGCUGC |
| 1853 | ACAACGCU CUGAUGA X GAA ACACGUUG | CAACGUGUC AGCGUUGU |
| 1859 | AUUUGUAC CUGAUGA X GAA ACGCUGAC | GUCAGCGUU GUACAAAU |

TABLE VI-continued

Mouse flk-1 VEGF Receptor-Hammerhead Ribozyme and Substrate sequence

| nt. Position | HH Ribozyme Sequence | Substrate |
|---|---|---|
| 1862 | CACAUUUG CUGAUGA X GAA ACAACGCU | AGCGUUGUA CAAAUGUG |
| 1878 | GCUUUGUU CUGAUGA X GAA AUGGCUUC | GAAGCCAUC AACAAAGC |
| 1905 | AAGGAGAU CUGAUGA X GAA ACCCUCUC | GAGAGGGUC AUCUCCUU |
| 1908 | UGGAAGGA CUGAUGA X GAA AUGACCCU | AGGGUCAUC UCCUUCCA |
| 1910 | CAUGGAAG CUGAUGA X GAA AGAUGACC | GGUCAUCUC CUUCCAUG |
| 1913 | UCACAUGG CUGAUGA X GAA AGGAGAUG | CAUCUCCUU CCAUGUGA |
| 1914 | AUCACAUG CUGAUGA X GAA AAGGAGAU | AUCUCCUUC CAUGUGAU |
| 1923 | GGACCCCU CUGAUGA X GAA AUCACAUG | CAUGUGAUC AGGGGUCC |
| 1930 | AAUUUCAG CUGAUGA X GAA ACCCCUGA | UCAGGGGUC CUGAAAUU |
| 1938 | UGCACAGU CUGAUGA X GAA AUUUCAGG | CCUGAAAUU ACUGUGCA |
| 1939 | UUGCACAG CUGAUGA X GAA AAUUUCAG | CUGAAAUUA CUGUGCAA |
| 1982 | ACAACAGG CUGAUGA X GAA ACACACUC | GAGUGUGUC CCUGUUGU |
| 1988 | CAGUGCAC CUGAUGA X GAA ACAGGGAC | GUCCCUGUU GUGCACUG |
| 2008 | CUCAAACG CUGAUGA X GAA AUUUCUGU | ACAGAAAUA CGUUUGAG |
| 2012 | GGUUCUCA CUGAUGA X GAA ACGUAUUU | AAAUACGUU UGAGAACC |
| 2013 | AGGUUCUC CUGAUGA X GAA AACGUAUU | AAUACGUUU GAGAACCU |
| 2022 | UACCACGU CUGAUGA X GAA AGGUUCUC | GAGAACCUC ACGUGGUA |
| 2030 | CAAGCUUG CUGAUGA X GAA ACCACGUG | CACGUGGUA CAAGCUUG |
| 2037 | UGUGAGCC CUGAUGA X GAA AGCUUGUA | UACAAGCUU GGCUCACA |
| 2042 | UUGCCUGU CUGAUGA X GAA AGCCAAGC | GCUUGGCUC ACAGGCAA |
| 2054 | UGUGGACC CUGAUGA X GAA AUGUUGCC | GGCAACAUC GGUCCACA |
| 2058 | CCCAUGUG CUGAUGA X GAA ACCGAUGU | ACAUCGGUC CACAUGGG |
| 2072 | GUGUCAGU CUGAUGA X GAA AUUCGCCC | GGGCGAAUC ACUCACAC |
| 2076 | ACUGGUGU CUGAUGA X GAA AGUGAUUC | GAAUCACUC ACACCAGU |
| 2085 | UUCUUGCA CUGAUGA X GAA ACUGGUGU | ACACCAGUU UGCAAGAA |
| 2086 | GUUCUUGC CUGAUGA X GAA AACUGGUG | CACCAGUUU GCAAGAAC |
| 2096 | GAGCAUCC CUGAUGA X GAA AGUUCUUG | CAAGAACUU GGAUGCUC |
| 2104 | UUUCCAAA CUGAUGA X GAA AGCAUCCA | UGGAUGCUC UUUGGAAA |
| 2106 | AGUUUCCA CUGAUGA X GAA AGAGCAUC | GAUGCUCUU UGGAAACU |
| 2107 | CAGUUUCC CUGAUGA X GAA AAGAGCAU | AUGCUCUUU GGAAACUG |
| 2129 | UGUUAGAA CUGAUGA X GAA ACAUGGUG | CACCAUGUU UUCUAACA |
| 2130 | CUGUUAGA CUGAUGA X GAA AACAUGGU | ACCAUGUUU UCUAACAG |
| 2131 | GCUGUUAG CUGAUGA X GAA AAACAUGG | CCAUGUUUU CUAACAGC |
| 2132 | UGCUGUUA CUGAUGA X GAA AAAACAUG | CAUGUUUUC UAACAGCA |
| 2134 | UGUGCUGU CUGAUGA X GAA AGAAAACA | UGUUUUCUA ACAGCACA |
| 2151 | ACAAUCAA CUGAUGA X GAA AUGUCAUU | AAUGACAUC UUGAUUGU |
| 2153 | CCACAAUC CUGAUGA X GAA AGAUGUCA | UGACAUCUU GAUUGUGG |

TABLE VI-continued

Mouse flk-1 VEGF Receptor-Hammerhead Ribozyme and Substrate sequence

| nt. Position | HH Ribozyme Sequence | Substrate |
|---|---|---|
| 2157 | AAUGCCAC CUGAUGA X GAA AUCAAGAU | AUCUUGAUU GUGGCAUU |
| 2165 | CAUUCUGA CUGAUGA X GAA AUGCCACA | UGUGGCAUU UCAGAAUG |
| 2166 | GCAUUCUG CUGAUGA X GAA AAUGCCAC | GUGGCAUUU CAGAAUGC |
| 2167 | GGCAUUCU CUGAUGA X GAA AAAUGCCA | UGGCAUUUC AGAAUGCC |
| 2177 | CCUGCAGA CUGAUGA X GAA AGGCAUUC | GAAUGCCUC UCUGCAGG |
| 2179 | GUCCUGCA CUGAUGA X GAA AGAGGCAU | AUGCCUCUC UGCAGGAC |
| 2198 | AGCAAACA CUGAUGA X GAA AGUCGCCU | AGGGACUA UGUUUGCU |
| 2202 | GCAGAGCA CUGAUGA X GAA ACAUAGUC | GACUAUGUU UGCUCUGC |
| 2203 | AGCAGAGC CUGAUGA X GAA AACAUAGU | ACUAUGUUU GCUCUGCU |
| 2207 | CUUGAGCA CUGAUGA X GAA AGCAAACA | UGUUUGCUC UGCUCAAG |
| 2212 | CUUAUCUU CUGAUGA X GAA AGCAGAGC | GCUCUGCUC AAGAUAAG |
| 2218 | GGUCUUCU CUGAUGA X GAA AUCUUGAG | CUCAAGAUA AGAAGACC |
| 2239 | GACCAGGC CUGAUGA X GAA AUGUCUUU | AAAGACAUU GCCUGGUC |
| 2247 | AGCUGUUU CUGAUGA X GAA ACCAGGCA | UGCCUGGUC AAACAGCU |
| 2256 | AGGAUGAU CUGAUGA X GAA AGCUGUUU | AAACAGCUC AUCAUCCU |
| 2259 | UCUAGGAU CUGAUGA X GAA AUGAGCUG | CAGCUCAUC AUCCUAGA |
| 2262 | CGCUCUAG CUGAUGA X GAA AUGAUGAG | CUCAUCAUC CUAGAGCG |
| 2265 | AUGCGCUC CUGAUGA X GAA AGGAUGAU | AUCAUCCUA GAGCGCAU |
| 2286 | UUUCCGGU CUGAUGA X GAA AUCAUGGG | CCCAUGAUC ACCGGAAA |
| 2296 | AUUCUCCA CUGAUGA X GAA AUUUCCGG | CCGGAAAUC UGGAGAAU |
| 2305 | UGUUGUCU CUGAUGA X GAA AUUCUCCA | UGGAGAAUC AGACAACA |
| 2319 | GUCUCGCC CUGAUGA X GAA AUGGUUGU | ACAACCAUU GGCGAGAC |
| 2331 | GUCACUUC CUGAUGA X GAA AUGGUCUC | GAGACCAUU GAAGUGAC |
| 2341 | UGCUGGGC CUGAUGA X GAA AGUCACUU | AAGUGACUU GCCCAGCA |
| 2351 | GAUUUCCA CUGAUGA X GAA AUGCUGGG | CCCAGCAUC UGCAAAUC |
| 2359 | UGGGGUAG CUGAUGA X GAA AUUUCCAG | CUGCAAAUC CUACCCCA |
| 2362 | GUGUGGGG CUGAUGA X GAA AGGAUUUC | GAAAUCCUA CCCCACAC |
| 2373 | AACCAUGU CUGAUGA X GAA AUGUGUGG | CCACACAUU ACAUGGUU |
| 2374 | GAACCAUG CUGAUGA X GAA AAUGUGUG | CACACAUUA CAUGGUUC |
| 2381 | UGUCUUUG CUGAUGA X GAA ACCAUGUA | UACAUGGUU CAAAGACA |
| 2382 | UUGUCUUU CUGAUGA X GAA AACCAUGU | ACAUGGUUC AAAGACAA |
| 2403 | GAAUCUUC CUGAUGA X GAA ACCAGGGU | ACCCUGGUA GAAGAUUC |
| 2410 | AAUGCCUG CUGAUGA X GAA AUCUUCUA | UAGAAGAUU CAGGCAUU |
| 2411 | CAAUGCCU CUGAUGA X GAA AAUCUUCU | AGAAGAUUC AGGCAUUG |
| 2418 | CUCAGUAC CUGAUGA X GAA AUGCCUGA | UCAGGCAUU GUACUGAG |
| 2421 | UCUCUCAG CUGAUGA X GAA ACAAUGCC | GGCAUUGUA CUGAGAGA |
| 2449 | CCUGCGGA CUGAUGA X GAA AGUCAGAU | ACCUGACUA UCCGCAGG |

TABLE VI-continued

Mouse flk-1 VEGF Receptor-Hammerhead Ribozyme and Substrate sequence

| nt. Position | HH Ribozyme Sequence | Substrate |
|---|---|---|
| 2451 | ACCCUGCG CUGAUGA X GAA AUAGUCAG | CUGACUAUC CGCAGGGU |
| 2481 | CAGGUGUA CUGAUGA X GAA AGGCCUCC | GGAGGCCUC UACACCUG |
| 2483 | GGCAGGUG CUGAUGA X GAA AGAGGCCU | AGGCCUCUA CACCUGCC |
| 2505 | CAGCCAAG CUGAUGA X GAA ACAUUGCA | UGCAAUGUC CUUGGCUG |
| 2508 | GCACAGCC CUGAUGA X GAA AGGACAUU | AAUGUCCUU GGCUGUGC |
| 2532 | AUUAUGAA CUGAUGA X GAA AGCGUCUC | GAGACGCUC UUCAUAAU |
| 2534 | CUAUUAUG CUGAUGA X GAA AGAGCGUC | GACGCUCUU CAUAAUAG |
| 2535 | UCUAUUAU CUGAUGA X GAA AAGAGCGU | ACGCUCUUC AUAAUAGA |
| 2538 | CCUUCUAU CUGAUGA X GAA AUGAAGAG | CUCUUCAUA AUAGAAGG |
| 2541 | GCACCUUC CUGAUGA X GAA AUUAUGAA | UUCAUAAUA GAAGGUGC |
| 2567 | UGACUUCC CUGAUGA X GAA AGUUGGUC | GACCAACUU GGAAGUCA |
| 2574 | AGGAUAAU CUGAUGA X GAA ACUUCCAA | UUGGAAGUC AUUAUCCU |
| 2577 | ACGAGGAU CUGAUGA X GAA AUGACUUC | GAAGUCAUU AUCCUCGU |
| 2578 | GACGAGGA CUGAUGA X GAA AAUGACUU | AAGUCAUUA UCCUCGUC |
| 2580 | CCGACGAG CUGAUGA X GAA AUAAUGAC | GUCAUUAUC CUCGUCGG |
| 2583 | GUGCCGAC CUGAUGA X GAA AGGAUAAU | AUUAUCCUC GUCGGCAC |
| 2586 | GCAGUGCC CUGAUGA X GAA ACGAGGAU | AUCCUCGUC GGCACUGC |
| 2601 | AACAUGGC CUGAUGA X GAA AUCACUGC | GCAGUGAUU GCCAUGUU |
| 2609 | GCCAGAAG CUGAUGA X GAA ACAUGGCA | UGCCAUGUU CUUCUGGC |
| 2610 | AGCCAGAA CUGAUGA X GAA AACAUGGC | GCCAUGUUC UUCUGGCU |
| 2612 | GGAGCCAG CUGAUGA X GAA AGAACAUG | CAUGUUCUU CUGGCUCC |
| 2613 | AGGAGCCA CUGAUGA X GAA AAGAACAU | AUGUUCUUC UGGCUCCU |
| 2619 | ACAAGAAG CUGAUGA X GAA AGCCAGAA | UUCUGGCUC CUUCUUGU |
| 2622 | AUGAGAAG CUGAUGA X GAA AGGAGCCA | UGGCUCCUU CUUGUCAU |
| 2623 | AAUGACAA CUGAUGA X GAA AAGGAGCC | GGCUCCUUC UUGUCAUU |
| 2625 | ACAAUGAC CUGAUGA X GAA AGAAGGAG | CUCCUUCUU GUCAUUGU |
| 2628 | AGGACAAU CUGAUGA X GAA ACAAGAAG | CUUCUUGUC AUUGCCU |
| 2631 | CGUAGGAG CUGAUGA X GAA AUGACAAG | CUUGUCAUU GUCCUACG |
| 2634 | GUCCGUAG CUGAUGA X GAA ACAAUGAC | GUCAUUGUC CUACGGAC |
| 2637 | ACGGUCCG CUGAUGA X GAA AGGACAAU | AUUGUCCUA CGGACCGU |
| 2646 | GCCCGCUU CUGAUGA X GAA ACGGUCCG | CGGACCGUU AAGCGGGC |
| 2647 | GGCCCGCU CUGAUGA X GAA AACGGUCC | GGACCGUUA AGCGGGCC |
| 2681 | UAGACAAG CUGAUGA X GAA AGCCUGUC | GACAGGCUA CUUGUCUA |
| 2684 | CAAUAGAC CUGAUGA X GAA AGUAGCCU | AGGCUACUU GUCUAUUG |
| 2687 | UGACAAUA CUGAUGA X GAA ACAAGUAG | CUACUUGUC UAUUGUCA |
| 2689 | CAUGACAA CUGAUGA X CAA AGACAAGU | ACUUGUCUA UUGUCAUG |
| 2691 | UCCAUGAC CUGAUGA X GAA AUAGACAA | UUGUCUAUU GUCAUGGA |

TABLE VI-continued

Mouse flk-1 VEGF Receptor-Hammerhead Ribozyme and Substrate sequence

| nt. Position | HH Ribozyme Sequence | Substrate |
|---|---|---|
| 2694 | GGAUCCAU CUGAUGA X GAA ACAAUAGA | UCUAUUGUC AUGGAUCC |
| 2701 | UUCAUCUG CUGAUGA X GAA AUCCAUGA | UCAUGGAUC CAGAUGAA |
| 2711 | CCAAGGGC CUGAUGA X GAA AUUCAUCU | AGAUGAAUU GCCCUUGG |
| 2717 | GCUCAUCC CUGAUGA X GAA AGGGCAAU | AUUGCCCUU GGAUGAGC |
| 2738 | CAUAAGGC CUGAUGA X GAA AGCGUUCA | UGAACGCUU GCCUUAUG |
| 2743 | GGCAUCAU CUGAUGA X GAA AGGCAAGC | GCUUGCCUU AUGAUGCC |
| 2744 | UGGCAUCA CUGAUGA X GAA AAGGCAAG | CUUGCCUUA UGAUGCCA |
| 2765 | CCCUGGGG CUGAUGA X GAA AUUCCCAC | GUGGGAAUU CCCCAGGG |
| 2766 | UCCCUCGG CUGAUGA X GAA AAUUCCCA | UCGGAAUUC CCCAGGGA |
| 2787 | GGUUUUCC CUGAUGA X GAA AGUUUCAG | CUGAAACUA GGAAAACC |
| 2797 | GCGGCCAA CUGAUGA X GAA AGGUUUUC | GAAAACCUC UUGGCCGC |
| 2799 | CCGCGGCC CUGAUGA X GAA AGAGGGUU | AAACCUCUU GGCCGCGG |
| 2813 | CUUGGCCG CUGAUGA X GAA AGGCACCG | CGGUGCCUU CGGCCAAG |
| 2814 | ACUUGGCC CUGAUGA X GAA AAGGCACC | GGUGCCUUC GGCCAAGU |
| 2826 | UCUGCCUC CUGAUGA X GAA AUCACUUG | CAAGUGAUU GAGGCAGA |
| 2839 | AAUUCCAA CUGAUGA X GAA AGCGUCUG | CAGACGCUU UUGGAAUU |
| 2840 | CAAUUCCA CUGAUGA X GAA AAGCGUCU | AGACGCUUU UGGAAUUG |
| 2841 | UCAAUUCC CUGAUGA X GAA AAAGCGUC | GACGCUUUU GGAAUUGA |
| 2847 | GUCUUGUC CUGAUGA X GAA AUUCCAAA | UUUGGAAUU GACAAGAC |
| 2863 | UGUUUUGC CUGAUGA X GAA AGUCGCUG | CAGCGACUU GCAAAACA |
| 2874 | UUGACGGC CUGAUGA X GAA ACUGUUUU | AAAACAGUA GCCGUCAA |
| 2880 | AACAUCUU CUGAUGA X GAA ACGGCUAC | GUAGCCGUC AAGAUGUU |
| 2888 | CUUCUUUC CUGAUGA X GAA ACAUCUUG | CAACAUGUU GAAAGAAG |
| 2917 | GAGGGCUC CUGAUGA X GAA AUGCUCGC | GCGAGCAUC GAGCCCUC |
| 2925 | UCAGACAU CUGAUGA X GAA AGGGCUCG | CGAGCCCUC AUGUCUGA |
| 2930 | UGAGUUCA CUGAUGA X GAA ACAUGAGG | CCUCAUGUC UGAACUCA |
| 2937 | AGGAUCUU CUGAUGA X GAA AGUUCAGA | UCUGAACUC AAGAUCCU |
| 2943 | UGGAUGAG CUGAUGA X GAA AUCUUGAG | CUCAAGAUC CUCAUCCA |
| 2946 | AUGUGGAU CUGAUGA X GAA AGGAUCUU | AAGAUCCUC AUCCACAU |
| 2949 | CCAAUGUG CUGAUGA X GAA AUGAGGAU | AUCCUCAUC CACAUUGG |
| 2955 | UGGUGACC CUGAUGA X GAA AUGUGGAU | AUCCACAUU GGUCACCA |
| 2959 | GAGAUGGU CUGAUGA X GAA ACCAAUGU | ACAUUGGUC ACCAUCUC |
| 2965 | CACAUUGA CUGAUGA X GAA AUGGUGAC | GUCACCAUC UCAAUGUG |
| 2967 | ACCACAUU CUGAUGA X GAA AGAUGGUG | CACCAUCUC AAUGUGUU |
| 2982 | GCGCCUAG CUGAUGA X GAA AGGUUCAC | GUGAACCUC CUAGGCGC |
| 2985 | CAGGCGCC CUGAUGA X GAA AGGAGGUU | AACCUCCUA GGCGCCUG |
| 3013 | CACCAUGA CUGAUGA X GAA AGGCCCUC | GAGGGCCUC UCAUGGUG |

TABLE VI-continued

Mouse flk-1 VEGF Receptor-Hammerhead Ribozyme and Substrate sequence

| nt. Position | HH Ribozyme Sequence | Substrate |
|---|---|---|
| 3015 | AUCACCAU CUGAUGA X GAA AGAGGCCC | GGGCCUCUC AUGGUGAU |
| 3024 | AAUUCCAC CUGAUGA X GAA AUCACCAU | AUGGUGAUU GUGGAAUU |
| 3032 | ACUUGCAG CUGAUGA X GAA AUUCCACA | UGUGGAAUU CUGCAAGU |
| 3033 | AACUUGCA CUGAUGA X GAA AAUUCCAC | GUGGAAUUC UGCAAGUU |
| 3041 | CGUUUCCA CUGAUGA X GAA ACUUGCAG | CUGGAAGUU UGGAAACC |
| 3042 | ACGUUUCC CUGAUGA X GAA AACUUGCA | UGCAAGUUU GGAAACCU |
| 3051 | UAAGUUGA CUGAUGA X GAA AGGUUUCC | GGAAACCUA UCAACUUA |
| 3053 | AGUAAGUU CUGAUGA X GAA AUAGGUUU | AAACCUAUC AACUUACU |
| 3058 | CCGUAAGU CUGAUGA X GAA AGUUGAUA | UAUCAACUU ACUUACGG |
| 3059 | CCCGUAAG CUGAUGA X GAA AAGUUGAU | AUCAACUUA CUUACGGG |
| 3062 | UGCCCCGU CUGAUGA X GAA AAUAAGUU | AACUUACUU ACGGGGCA |
| 3063 | UUGCCCCG CUGAUGA X GAA AAGUAAGU | ACUUACUUA CGGGGCAA |
| 3083 | AGGGAACA CUGAUGA X GAA AUUCAUUU | AAAUGAAUU UGUUCCCU |
| 3084 | UAGGGAAC CUGAUGA X GAA AAUUCAUU | AAUGAAUUU GUUCCCUA |
| 3087 | UUAUAGGG CUGAUGA X GAA ACAAAUUC | GAAUUUGUU CCCUAUAA |
| 3088 | CUUAUAGG CUGAUGA X GAA AACAAAUU | AAUUUGUUC CCUAUAAG |
| 3092 | UGCUCUUA CUGAUGA X GAA AGGGAACA | UGUUCCCUA UAAGAGCA |
| 3094 | UUUGCUCU CUGAUGA X GAA AUAGGGAA | UUCCCUAUA AGAGCAAA |
| 3113 | CCUGGCGG CUGAUGA X GAA AGCGUGCC | GGCACGCUU CCGCCAGG |
| 3114 | CCCUGGCG CUGAUGA X GAA AAGCGUGC | GCACGCUUC CGCCAGGG |
| 3131 | CCCCAACG CUGAUGA X GAA AGUCCUUG | CAAGGACUA CGUUGGGG |
| 3135 | AGCUCCCC CUGAUGA X GAA ACGUAGUC | GACUACGUU GGGGAGCU |
| 3144 | UCCACGGA CUGAUGA X GAA AGCUCCCC | GGGGAGCUC UCCGUGGA |
| 3146 | GAUCCACG CUGAUGA X GAA AGAGCUCC | GGAGCUCUC CGUGGAUC |
| 3154 | UCUUUUCA CUGAUGA X GAA AUCCACGG | CCGUGGAUC UGAAAAGA |
| 3167 | UGCUGUCC CUGAUGA X GAA AGCGUCUU | AAGACGCUU GGACAGCA |
| 3177 | CUGCUGGU CUGAUGA X GAA AUGCUGUC | GACAGCAUC ACCACCAG |
| 3194 | AGCUGGCA CUGAUGA X GAA AGCUCUGG | CCAGAGCUC UGCCAGCU |
| 3203 | CAAAGCCU CUGAUGA X GAA AGCUGGCA | UGCCAGCUC AGGCUUUG |
| 3209 | CCUCAACA CUGAUGA X GAA AGCCUGAG | CUCAGGCUU UGUUGAGG |
| 3210 | UCCUCAAC CUGAUGA X GAA AAGCCUGA | UCAGGCUUU GUUGAGGA |
| 3213 | UUCUCCUC CUGAUGA X GAA ACAAAGCC | GGCUUUGUU GAGGAGAA |
| 3224 | CACUGAGC CUGAUGA X GAA AUUUCUCC | GGAGAAAUC GCUCAGUG |
| 3228 | ACAUCACU CUGAUGA X GAA AGCGAUUU | AAAUCGCUC AGUGAUGU |
| 3237 | UCUUCCUC CUGAUGA X GAA ACAUCACU | AGUGAUGUA GAGGAAGA |
| 3253 | UUCUUCAG CUGAUGA X GAA AGCUUCUU | AAGAAGCUU CUGAAGAA |
| 3254 | GUUCUUCA CUGAUGA X GAA AAGCUUCU | AGAAGCUUC UGAAGAAC |

TABLE VI-continued

Mouse flk-1 VEGF Receptor-Hammerhead Ribozyme and Substrate sequence

| nt. Position | HH Ribozyme Sequence | Substrate |
|---|---|---|
| 3266 | AGUCCUUG CUGAUGA X GAA ACAGUUCU | AGAACUGUA CAAGGACU |
| 3275 | AGGUCAGG CUGAUGA X GAA AGUCCUUG | CAAGGACUU CCUGACCU |
| 3276 | AAGGUCAG CUGAUGA X GAA AAGUCCUU | AAGGACUUC CUGACCUU |
| 3284 | GAUGCUCC CUGAUGA X GAA AGGUCAGG | CCUGACCUU GGAGCAUC |
| 3292 | ACAGAUGA CUGAUGA X GAA AUGCUCCA | UGGAGCAUC UCAUCUGU |
| 3294 | UAACAGAU CUGAUGA X GAA AGAUGCUC | GAGCAUCUC AUCUGUUA |
| 3297 | CUGUAACA CUGAUGA X GAA AUGAGAUG | CAUCUCAUC UGUUACAG |
| 3301 | GAAGCUGU CUGAUGA X GAA ACAGAUGA | UCAUCUGUU ACAGCUUC |
| 3302 | GGAAGCUG CUGAUGA X GAA AACAGAUG | CAUCUGUUA CAGCUUCC |
| 3308 | CCACUUGG CUGAUGA X GAA AGCUGUAA | UUACAGCUU CCAAGUGG |
| 3309 | GCCACUUG CUGAUGA X GAA AAGCUGUA | UACAGCUUC CAAGUGGC |
| 3319 | CAUGCCCU CUGAUGA X GAA AGCCACUU | AAGUGGCUA AGGGCAUG |
| 3332 | AUGCCAAG CUGAUGA X GAA ACUCCAUG | CAUGGAGUU CUUGGCAU |
| 3333 | GAUGCCAA CUGAUGA X GAA AACUCCAU | AUGGAGUUC UUGGCAUC |
| 3335 | UUGAUGCC CUGAUGA X GAA AGAACUCC | GGAGUUCUU GGCAUCAA |
| 3341 | ACUUCCUU CUGAUGA X GAA AUGCCAAG | CUUGGCAUC AAGGAAGU |
| 3352 | CCUGUGGA CUGAUGA X GAA ACACUUCC | GGAAGUGGA UCCACAGG |
| 3354 | UCCCUGUG CUGAUGA X GAA AUACACUU | AAGUGUAUC CACAGGGA |
| 3381 | GAUAGGAG CUGAUGA X GAA AUGUUUCG | CGAAACAUU CUCCUAUC |
| 3382 | CGAUAGGA CUGAUGA X GAA AAUGUUUC | GAAACAUUC UCCUAUCG |
| 3384 | UCCGAUAG CUGAUGA X GAA AGAAUGUU | AACAUUCUC CUAUCGGA |
| 3387 | UUCUCCGA CUGAUGA X GAA AGGAGAAU | AUUCUCCUA UCGGAGAA |
| 3389 | UCUUCUCC CUGAUGA X GAA AUAGGAGA | UCUCCUAUC GGAGAAGA |
| 3405 | CAGAUCUU CUGAUGA X GAA ACCACAUU | AAUGUGGUU AAGAUCUG |
| 3406 | ACAGAUCU CUGAUGA X GAA AACCACAU | AUGUGGJUA AGAUCUGU |
| 3411 | AAGUCACA CUGAUGA X GAA AUCUUAAC | GUUAAGAUC UGUGACUU |
| 3419 | CCAAGCCG CUGAUGA X GAA AGUCACAG | GUGUGACUU CGGCUUGG |
| 3420 | GCCAAGCC CUGAUGA X GAA AAGUCACA | UGUGACUUC GGCUUGGC |
| 3425 | CCCGGGCC CUGAUGA X GAA AGCCGAAG | CUUCGGCUU GGCCCGGG |
| 3438 | UCUUUAUA CUGAUGA X GAA AUGUCCCG | CGGGACAUU UAUAAAGA |
| 3439 | GUCUUUAU CUGAUGA X GAA AAUGUCCC | GGGACAUUU AUAAAGAC |
| 3440 | GGUCUUUA CUGAUGA X GAA AAAUGUCC | GGACAUUUA UAAAGACC |
| 3442 | CGGGUCUU CUGAUGA X GAA AUAAAUGU | ACAUUUAUA AAGACCCG |
| 3454 | UCUGACAU CUGAUGA X GAA AUCCGGGU | ACCCGGAUU AUGUCAGA |
| 3455 | UUCUGACA CUGAUGA X GAA AAUCCGGG | CCCGGAUUA UGUCAGAA |
| 3459 | CCUUUUCU CUGAUGA X GAA ACAUAAUC | GAUUAUGUC AGAAAGG |
| 3480 | UUCAAAGG CUGAUGA X GAA AGUCGGGC | GCCCGACUC CCUUUGAA |

TABLE VI-continued

Mouse flk-1 VEGF Receptor-Hammerhead Ribozyme and Substrate sequence

| nt. Position | HH Ribozyme Sequence | Substrate |
|---|---|---|
| 3484 | CCACUUCA CUGAUGA X GAA AGGGAGUC | GACUCCCUU UGAAGUGG |
| 3485 | UCCACUUC CUGAUGA X GAA AAGGGAGU | ACUCCCUUU GAAGUGGA |
| 3510 | CUGUCAAA CUGAUGA X GAA AUGGUUUC | CAAACCAUU UUUGACAG |
| 3511 | UCUGUCAA CUGAUGA X GAA AAUGGUUU | AAACCAUUU UUGACAGA |
| 3512 | CUCUGUCA CUGAUGA X GAA AAAUGGUU | AACCAUUUU UGACAGAG |
| 3513 | ACUCUGUC CUGAUGA X GAA AAAAUGGU | ACCAUUUUU GACAGAGU |
| 3522 | AUUGUGUA CUGAUGA X GAA ACUCUGUC | GACAGAGUA UACACAAU |
| 3524 | GAAUUGUG CUGAUGA X GAA AUACUCUG | CAGAGUAUA CACAAUUC |
| 3531 | UCGCUCUG CUGAUGA X GAA AUUGUGUA | UACACAAUU CAGAGCGA |
| 3532 | AUCGCUCU CUGAUGA X GAA AAUUGUGU | ACACAAUUC AGAGCGAU |
| 3548 | CACCGAAA CUGAUGA X GAA ACCACACA | UGUGUGGUC UUUCGGUG |
| 3550 | CACACCGA CUGAUGA X GAA AGACCACA | UGUGGUCUU UCGGUGUG |
| 3551 | ACACACCG CUGAUGA X GAA AAGACCAC | GUGGUCUUU CGGUGUGU |
| 3552 | AACACACC CUGAUGA X GAA AAAGACCA | UGGUCUUUC GGUGUGUU |
| 3560 | CCCAGAGC CUGAUGA X GAA ACACACCG | CGGUGUGUU GCUCUGGG |
| 3564 | AUUUCCCA CUGAUGA X GAA AGCCACAC | GUGUUGCUC UGGGAAAU |
| 3573 | AAGGAAAA CUGAUGA X GAA AUUUCCCA | UGGGAAAUA UUUUCCUU |
| 3575 | CUAAGGAA CUGAUGA X GAA AUAUUUCC | GGAAAUAUU UUCCUUAG |
| 3576 | CCUAAGGA CUGAUGA X GAA AAUAUUUC | GAAAUAUUU UCCUUAGG |
| 3577 | ACCUAAGG CUGAUGA X GAA AAAUAUUU | AAAUAUUUU CCUUAGGU |
| 3578 | CACCUAAG CUGAUGA X GAA AAAAUAUU | AAUAUUUUC CUUAGGUG |
| 3581 | AGGCACCU CUGAUGA X GAA AGGAAAAU | AUUUUCCUU AGGUGCCU |
| 3582 | GAGGCACC CUGAUGA X GAA AAGGAAAA | UUUUCCUUA GGUGCCUC |
| 3590 | GGUAUGGG CUGAUGA X GAA AGGCACCU | AGGUGCCUC CCCAUACC |
| 3596 | CCCCAGGG CUGAUGA X GAA AUGGGGAG | CUCCCCAUA CCCUGGGG |
| 3606 | UGAAUCUU CUGAUGA X GAA ACCCCAGG | CCUGGGGUC AAGAUUGA |
| 3612 | UCUUCAUC CUGAUGA X GAA AUCUUGAC | GUCAAGAUU GAUGAAGA |
| 3623 | UCCUACAA CUGAUGA X GAA AUUCUUCA | UGAAGAAUU UUGUAGGA |
| 3624 | CUCCUACA CUGAUGA X GAA AAUUCUUC | GAAGAAUUU UGUAGGAG |
| 3625 | UCUCCUAC CUGAUGA X GAA AAAUUCUU | AAGAAUUUU GUAGGAGA |
| 3628 | CAAUCUCC CUGAUGA X GAA ACAAAAUU | AAUUUUGUA GGAGAUUG |
| 3635 | CUUCUUUC CUGAUGA X GAA AUCUCCUA | UAGGAGAUU GAAAGAAG |
| 3649 | CCGCAUUC CUGAUGA X GAA AGUUCCUU | AAGGAACUA GAAUGCGG |
| 3661 | GUAGUCAG CUGAUGA X GAA AGCCCGCA | UGCGGGCUC CUGACUAC |
| 3668 | GGGUAGUG CUGAUGA X GAA AGUCAGGA | UCCUGACUA CACUACCC |
| 3673 | UUCUGGGG CUGAUGA X GAA AGUGUAGU | ACUACACUA CCCCACAA |
| 3686 | UGGUCUGG CUGAUGA X GAA ACAUUUCU | AGAAAUGUA CCAGACCA |

TABLE VI-continued

Mouse flk-1 VEGF Receptor-Hammerhead Ribozyme and Substrate sequence

| nt. Position | HH Ribozyme Sequence | Substrate |
|---|---|---|
| 3734 | CUGAAAAC CUGAUGA X GAA AGGGUCUC | GAGACCCUC GUUUCAG |
| 3737 | ACUCUGAA CUGAUGA X GAA ACGAGGGU | ACCCUCGUU UUCAGAGU |
| 3738 | AACUCUGA CUGAUGA X GAA AACGAGGG | CCCUCGUUU UCAGAGUU |
| 3739 | CAACUCUG CUGAUGA X GAA AAACGAGG | CCUCGUUUU CAGAGUUG |
| 3740 | CCAACUCU CUGAUGA X GAA AAAACGAG | CUCGUUUUC AGAGUUGG |
| 3746 | GCUCCACC CUGAUGA X GAA ACUCUGAA | UUCAGAGUU GGUGGAGC |
| 3757 | GUUUCCCA CUGAUGA X GAA AUGCUCCA | UGGAGCAUU UGGGAAAC |
| 3758 | GGUUUCCC CUGAUGA X GAA AAUGCUCC | GGAGCAUUU GGGAAACC |
| 3768 | GCUUGCAG CUGAUGA X GAA AGCUUUUC | GGAAACCUC CUGCAAGC |
| 3803 | GAACAAUA CUGAUGA X GAA AGUCUUUG | CAAAGACUA UAUUGUUC |
| 3805 | AAGAACAA CUGAUGA X GAA AUAGUCUU | AAGACUAUA UUGUUCUU |
| 3807 | GGAAGAAC CUGAUGA X GAA AUAUAGUC | GACUAUAUU GUUCUUCC |
| 3810 | AUGGAAG CUGAUGA X GAA ACAAUAUA | UAUAUUGUU CUUCCAAU |
| 3811 | CAUUGGAA CUGAUGA X GAA AACAAUAU | AUAUUGUUC UUCCAAUG |
| 3813 | GACAUUGG CUGAUGA X GAA AGAACAAU | AUUGUUCUU CCAAUGUC |
| 3814 | UGACAUUG CUGAUGA X GAA AAGAACAA | UUGUUCUUC CAAUGUCA |
| 3821 | GUGUCUCU CUGAUGA X GAA ACAUUGGA | UCCAAUGUC AGAGACAC |
| 3847 | GAGUCCAG CUGAUGA X GAA AUCCUCUU | AAGAGGAUU CUGGACUC |
| 3848 | AGAGUCCA CUGAUGA X GAA AAUCCUCU | AGAGGAUUC UGGACUCU |
| 3855 | GGCAGGGA CUGAUGA X GAA AGUCCAGA | UCUGGACUC UCCCUGCC |
| 3857 | UAGGCAGG CUGAUGA X GAA AGAGUCCA | UGGACUCUC CUGCCUA |
| 3865 | AGGUGAGG CUGAUGA X GAA AGGCAGGG | CCCUGCCUA CCUCACCU |
| 3869 | AAACAGGU CUGAUGA X GAA AGGUAGGC | GCCUACCUC ACCUGUUU |
| 3876 | AUACAGGA CUGAUGA X GAA ACAGGUGA | UCACCUGUU UCCUGUAU |
| 3877 | CAUACAGG CUGAUGA X GAA AACAGGUG | CACCUGUUU CCUGUAUG |
| 3878 | CCAUACAG CUGAUGA X GAA AAACAGGU | ACCUGUUUC CUGUAUGG |
| 3883 | UUCCUCCA CUGAUGA X GAA ACAGGAAA | UUUCCUGUA UGGAGGAA |
| 3914 | CAUAAUGG CUGAUGA X GAA AUUUGGGG | CCCCAAAUU CCAUUAUG |
| 3915 | UCAUAAUG CUGAUGA X GAA AAUUUGGG | CCCAAAUUC CAUUAUGA |
| 3919 | GUUGUCAU CUGAUGA X GAA AUGGAAUU | AAUUCCAUU AUGACAAC |
| 3920 | UGUUGUCA CUGAUGA X GAA AAUGGAAU | AUUCCAUUA UGACAACA |
| 3939 | UAAUGACU CUGAUGA X GAA AUUCCUGC | GCAGGAAUC AGUCAUUA |
| 3943 | GAGAUAAU CUGAUGA X GAA ACUGAUUC | GAAUCAGUC AUUAUCUC |
| 3946 | CUGGAGAU CUGAUGA X GAA AUGACUGA | UCAGUCAUU AUCUCCAG |
| 3947 | UCUGGAGA CUGAUGA X GAA AAUGACUG | CAGUCAUUA UCUCCAGA |
| 3949 | GUUCUGGA CUGAUGA X GAA AUAAUGAC | GUCAUUAUC UCCAGAAC |
| 3951 | CUGUUCUG CUGAUGA X GAA AGAUAAUG | CAUUAUCUC CAGAACAG |

TABLE VI-continued

Mouse flk-1 VEGF Receptor-Hammerhead Ribozyme and Substrate sequence

| nt. Position | HH Ribozyme Sequence | Substrate |
|---|---|---|
| 3961 | CUUUCGCU CUGAUGA X GAA ACUGUUCU | AGAACAGUA AGCGAAAG |
| 3987 | AAUGUUUU CUGAUGA X GAA ACACUCAC | GUGAGUGUA AAAACAUU |
| 3995 | UAUCUUCA CUGAUGA X GAA AUGUUUUU | AAAAACAUU UGAAGAUA |
| 3996 | AUAUCUUC CUGAUGA X GAA AAUGUUUU | AAACAUUU GAAGAUAU |
| 4003 | CAAUGGGA CUGAUGA X GAA AUCUUCAA | UUGAAGAUA UCCCAUUG |
| 4005 | UCCAAUGG CUGAUGA X GAA AUAUCUUC | GAAGAUAUC CCAUUGGA |
| 4010 | GUUCCUCC CUGAUGA X GAA AUGGGAUA | UAUCCCAUU GGAGGAAC |
| 4026 | AUCACUUU CUGAUGA X GAA ACUUCUGG | CCAGAAGUA AAAGUGAU |
| 4035 | UCAUCUGG CUGAUGA X GAA AUCACUUU | AAAGUGAUC CCAGAUGA |
| 4068 | GAUGCAAG CUGAUGA X GAA ACCAUCCC | GGGAUGGUC CUUGCAUC |
| 4071 | UCUGAUGC CUGAUGA X GAA AGGACCAU | AUGGUCCUU GCAUCAGA |
| 4076 | GCUCUUCU CUGAUGA X GAA AUGCAAGG | CCUUGCAUC AGAAGAGC |
| 4093 | GUCUUCCA CUGAUGA X GAA AGUUUUCA | UGAAAACUC UGGAAGAC |
| 4112 | AUGGAGAU CUGAUGA X GAA AUUUGUUC | GAACAAAUU AUCUCCAU |
| 4113 | GAUGGAGA CUGAUGA X GAA AAUUUGUU | AACAAAUUA UCUCCAUC |
| 4115 | AAGAUGGA CUGAUGA X GAA AUAAUUUG | CAAAUUAUC UCCAUCUU |
| 4117 | AAAAGAUG CUGAUGA X GAA AGAUAAUU | AAUUAUCUC CAUCUUUU |
| 4121 | CACGAAAA CUGAUGA X GAA AUGGAGAU | AUCUCCAUC UUUUGGUG |
| 4123 | UCCACCAA CUGAUGA X GAA AGAUGGAG | CUCCAUCUU UUGGUGGA |
| 4124 | UUCCACCA CUGAUGA X GAA AAGAUGGA | UCCAUCUUU UGGUGGAA |
| 4125 | AUUCCACC CUGAUGA X GAA AAAGAUGG | CCAUCUUUU GGUGGAAU |
| 4144 | CCUGCUUU CUGAUGA X GAA ACUGGGCA | UGCCCAGUA AAAGCAGG |
| 4157 | AGGCCACA CUGAUGA X GAA ACUCCCUG | CAGGGAGUC UGUGGCCU |
| 4166 | AGCCUUCC CUGAUGA X GAA AGGCCACA | UGUCGCCUC GGAAGGCU |
| 4175 | UCUGCUUG CUGAUGA X GAA AGCCUUCC | GGAAGGCUC CAACCAGA |
| 4193 | CAGACUGG CUGAUGA X GAA AGCCACUG | CAGUGGCUA CCAGUCUG |
| 4199 | GAUACCCA CUGAUGA X GAA ACUGGUAG | CUACCAGUC UGGGUAUC |
| 4205 | CUGAGUGA CUGAUGA X GAA ACCCAGAC | GUCUGGGUA UCACUCAG |
| 4207 | AUCUGAGU CUGAUGA X GAA AUACCCAG | CUGGGUAUC ACUCAGAU |
| 4211 | UGUCAUCU CUGAUGA X GAA AGUGAUAC | GUAUCACUC AGAUGACA |
| 4235 | CGCUGGAG CUGAUGA X GAA ACACGGUG | CACCGUGUA CUCCAGCG |
| 4238 | CGUCGCUG CUGAUGA X GAA AGUACACG | CGUGUACUC CAGCGACG |
| 4257 | AUCUUUAA CUGAUGA X GAA AGUCCUGC | GCAGGACUU UUAAAGAU |
| 4258 | CAUCUUUA CUGAUGA X GAA AAGUCCUG | CAGGACUUU UAAGAUG |
| 4259 | CCAUCUUU CUGAUGA X GAA AAAGUCCU | AGGACUUUU AAAGAUGG |
| 4260 | ACCAUCUU CUGAUGA X GAA AAAAGUCC | GGACUUUUA AAGAUGGU |
| 4281 | UCAGCGUG CUGAUGA X GAA ACUGGAGC | GCUCAGUU CACGCUGA |

TABLE VI-continued

Mouse flk-1 VEGF Receptor-Hammerhead Ribozyme and Substrate sequence

| nt. Position | HH Ribozyme Sequence | Substrate |
|---|---|---|
| 4282 | GUCAGCGU CUGAUGA X GAA AACUGCAG | CUGCAGUUC ACGCUGAC |
| 4292 | UGGUCCCU CUGAUGA X GAA AGUCAGCG | CGCUGACUC AGGGACCA |
| 4311 | CAGGAGGU CUGAUGA X GAA AGCUGCAG | CUGCAGCUC ACCUCCUG |
| 4316 | UUAAACAG CUGAUGA X CAA AGGUGAGC | GCUCACCUC CUCUUUAA |
| 4321 | UCCAUUUA CUGAUGA X GAA ACAGGAGG | CCUCCUGUU UAAAUGGA |
| 4322 | UUCCAUUU CUGAUGA X GAA AACAGGAG | CUCCUCUUU AAAUGGAA |
| 4323 | CUUCCAUU CUGAUGA X GAA AAACAGGA | UCCUGUUUA AAUGGAAG |
| 4336 | CGGGACAG CUGAUGA X GAA ACCACUUC | GAAGUGGUC CUGUCCCG |
| 4341 | GGAGCCGG CUGAUGA X GAA ACAGGACC | GGUCCUGUC CCGGCUCC |
| 4348 | UGGGGGCG CUGAUGA X GAA AGCCGGGA | UCCCGGCUC CGCCCCCA |
| 4360 | AUUUCCAG CUGAUGA X GAA AGUUGGGG | CCCCAACUC CUGGAAAU |
| 4369 | UCUCUCGU CUGAUGA X GAA AUUUCCAG | CUGGAAAUC ACGAGAGA |
| 4387 | GAAAAUCU CUGAUGA X GAA AGCAGCAC | GUGCUGCUU AGAUUUUC |
| 4388 | UGAAAAUC CUGAUGA X GAA AACCAGCA | UGCUGCUUA GAUUUUCA |
| 4392 | CACUUGAA CUGAUGA X GAA AUCUAAGC | GCUUAGAUU UUCAAGUG |
| 4393 | ACACUUGA CUGAUGA X GAA AAUCUAAG | CUUAGAUUU UCAAGUGU |
| 4394 | AACACUUG CUGAUGA X GAA AAAUCUAA | UUAGAUUUU CAAGUGUU |
| 4395 | CAACACUU CUGAUGA X GAA AAAAUCUA | UAGAUUUUC AAGUGUUG |
| 4402 | GAAAGAAC CUGAUGA X GAA ACACUUGA | UCAAGUGUU GUUCUUUC |
| 4405 | GUGGAAAG CUGAUGA X GAA ACAACACU | AGUGUUGUU CUUUCCAC |
| 4406 | GGUGGAAA CUGAUGA X GAA AACAACAC | GUGUUGUUC UUUCCACC |
| 4408 | GUGGUGGA CUGAUGA X GAA AGAACAAC | GUUGUUCUU UCCACCAC |
| 4409 | GGUGGUGG CUGAUGA X GAA AAGAACAA | UUGUUCUUU CCACCACC |
| 4410 | GGGUGGUG CUGAUGA X GAA AAAGAACA | UGUUCUUUC CACCACCC |
| 4425 | AAUGUGGC CUGAUGA X GAA ACUUCCGG | CCGGAAGUA GCCACAUU |
| 4433 | GAAAAUCA CUGAUGA X GAA AUGUGGCU | AGCCACAUU UGAUUUUC |
| 4434 | UGAAAAUC CUGAUGA X GAA AAUGUGGC | GCCACAUUU GAUUUUCA |
| 4438 | AAAAUGAA CUGAUGA X GAA AUCAAAUG | CAUUUGAUU UUCAUUUU |
| 4439 | AAAAAUGA CUGAUGA X GAA AAUCAAAU | AUUUGAUUU UCAUUUUU |
| 4440 | CAAAAAUG CUGAUGA X GAA AAAUCAAA | UUUGAUUUU CAUUUUUG |
| 4441 | CCAAAAAU CUGAUGA X GAA AAAAUCAA | UUGAUUUUC AUUUUUGG |
| 4444 | CCUCCAAA CUGAUGA X GAA AUGAAAAU | AUUUUCAUU UUUGGAGG |
| 4445 | UCCUCCAA CUGAUGA X GAA AAUGAAAA | UUUUCAUUU UUGGAGGA |
| 4446 | CUCCUCCA CUGAUGA X GAA AAAUGAAA | UUUCAUUUU UGGAGGAG |
| 4447 | CCUCCUCC CUGAUGA X GAA AAAAUGAA | UUCAUUUUU GGAGGAGG |
| 4461 | UGGAGUCU CUGAUGA X GAA AGGUCCCU | AGGGACCUC AGACUGCA |
| 4477 | CUGAGGAC CUGAUGA X GAA AGCUCCUU | AAGGAGCUU GUCCUCAG |

TABLE VI-continued

Mouse flk-1 VEGF Receptor-Hammerhead Ribozyme and Substrate sequence

| nt. Position | HH Ribozyme Sequence | Substrate |
|---|---|---|
| 4480 | GCCCUGAG CUGAUGA X GAA ACAAGCUC | GAGCUUGUC UCAGGGC |
| 4483 | AAUGCCCU CUGAUGA X GAA AGGACAAG | CLUUJCCUC AGGGCAUU |
| 4491 | UCUCUGGA CUGAUGA X GAA AUGCCCUG | CAGGGCAUU UCCAGAGA |
| 4492 | UUCUCUGG CUGAUGA X GAA AAUGCCCU | AGGGCAUUU CCAGAGAA |
| 4493 | CUUCUCUG CUGAUGA X GAA AAAUGCCC | GGGCAUUUC CAGAGAAG |
| 4525 | GUAGAGUC CUGAUGA X GAA ACACAUUC | GAAUGUGUU GACUCUAC |
| 4530 | AGAGAGUA CUGAUGA X GAA AGUCAACA | UGUUGACUC UACUCUCU |
| 4532 | AAAGAGAG CUGAUGA X GAA AGAGUCAA | UUGACUCUA CUCUCUUU |
| 4535 | GGAAAAGA CUGAUGA X GAA AGUAGAGU | ACUCUACUC UCUUUUCC |
| 4537 | AUGGAAAA CUGAUGA X GAA AGAGUAGA | UCUACUCUC UUUUCCAU |
| 4539 | GAAUGGAA CUGAUGA X GAA AGAGAGUA | UACUCUCUU UUCCAUUC |
| 4540 | UGAAUGGA CUGAUGA X GAA AAGAGAGU | ACUCUCUUU UCCAUUCA |
| 4541 | AUGAAUGG CUGAUGA X GAA AAAGAGAG | CUCUCUUUU CCAUUCAU |
| 4542 | AAUGAAUG CUGAUGA X GAA AAAAGAGA | UCUCUUUUC CAUUCAUU |
| 4546 | UUUAAAUG CUGAUGA X GAA AUGGAAAA | UUUUCCAUU CAUUUAAA |
| 4547 | UUUUAAAU CUGAUGA X GAA AAUGGAAA | UUUCCAUUC AUUUAAAA |
| 4550 | GACUUUUA CUGAUGA X GAA AUGAAUGG | CCAUUCAUU UAAAAGUC |
| 4551 | GGACUUUU CUGAUGA X GAA AAUGAAUG | CAUUCAUUU AAAAGUCC |
| 4552 | AGGACUUU CUGAUGA X GAA AAAUGAAU | AUUCAUUUA AAAGUCCU |
| 4558 | UUAUAUAG CUGAUGA X GAA ACUUUUAA | UUAAAAGUC CUAUAUAA |
| 4561 | ACAUUAUA CUGAUGA X GAA AGGACUUU | AAAGUCCUA UAUAAUGU |
| 4563 | GCACAUUA CUGAUGA X GAA AUAGGACU | AGUCCUAUA UAAUGUGC |
| 4565 | GGGCACAU CUGAUGA X GAA AUAUAGGA | UCCUAUAUA AUGUGCCC |
| 4583 | GGUAGUGA CUGAUGA X GAA ACCACAGC | GCUGUGGUC UCACUACC |
| 4585 | CUGGUAGU CUGAUGA X GAA AGACCACA | UGUGGUCUC ACUACCAG |
| 4589 | UUAACUGG CUGAUGA X GAA AGUGAGAC | GUCUCACUA CCAGUUAA |
| 4595 | UUUGCUUU CUGAUGA X GAA ACUGGUAG | CUACCAGUU AAAGAAAA |
| 4596 | UUUUGCUU CUGAUGA X GAA AACUGGUA | UACCAGUUA AAGCAAAA |
| 4609 | GUGUUUGA CUGAUGA X GAA AGUCUUUU | AAAAGACUU UCAAACAC |
| 4610 | CGUGUUUG CUGAUGA X GAA AAGUCUUU | AAAGACUUU CAAACACG |
| 4611 | ACGUGUUU CUGAUGA X GAA AAAGUCUU | AAGACUUUC AAACACGU |
| 4625 | GGAGGACA CUGAUGA X GAA AGUCCACG | CGUGGACUC UGUCCUCC |
| 4629 | UCUUGGAG CUGAUGA X GAA ACAGAGUC | GACUCUGUC CUCCAAGA |
| 4632 | ACUUCUUG CUGAUGA X GAA AGGACAGA | UCUGUCCUC CAAGAAGU |
| 4654 | GUUUCACA CUGAUGA X GAA AGGUGCCG | CGGCACCUC UGUGAAAC |
| 4668 | GCCCAUUC CUGAUGA X GAA AUCCAGUU | AACUGGAUC GAAUGGGC |
| 4683 | AACACACA CUGAUGA X GAA AGCAUUGC | GCAAUGCUU UGUGUGUU |

TABLE VI-continued

Mouse flk-1 VEGF Receptor-Hammerhead Ribozyme and Substrate sequence

| nt. Position | HH Ribozyme Sequence | Substrate |
|---|---|---|
| 4684 | CAACACAC CUGAUGA X GAA AAGCAUUG | CAAUGCUUU GUGUGUUG |
| 4691 | CCAUCCUC CUGAUGA X GAA ACACACAA | UUGUGUGUU GAGGAUGG |
| 4709 | GGCCCUGG CUGAUGA X GAA ACAUCUCA | UGAGAUGUC CCAGGGCC |
| 4722 | GGUAGACA CUGAUGA X GAA ACUCGGCC | GGCCGAGUC UGUCUACC |
| 4726 | CCAAGGUA CUGAUGA X GAA ACAGACUC | GAGUCUGUC UACCUUGG |
| 4728 | CUCCAAGG CUGAUGA X GAA AGACAGAC | GUCUGUCUA CCUUGGAG |
| 4732 | AAGCCUCC CUGAUGA X GAA AGGUAGAC | GUCUACCUU GGAGGCUU |
| 4740 | CCUCCACA CUGAUGA X GAA AGCCUCCA | UGGAGGCUU UGUGGAGG |
| 4741 | UCCUCCAC CUGAUGA X GAA AAGCCUCC | GGAGGGUUU GUGGAGGA |
| 4758 | UUGGCUCA CUGAUGA X GAA AGCCCGCA | UGCGGGCUA UGAGCGAA |
| 4771 | CCACACUU CUGAUGA X GAA ACACUUGG | CCAAGUGUU AAGUGUGG |
| 4772 | CCCACACU CUGAUGA X GAA AACACUUG | CAAGUGUUA AGUGUGGG |
| 4811 | CUCGGAGC CUGAUGA X GAA ACUUGCGC | GCGCAAGUC GCUCGGAG |
| 4815 | GGGUUUCC CUGAUGA X GAA AGCGACUU | AAGUCGCUC GGAGCG |
| 4826 | CAGGCUCC CUGAUGA X GAA ACGGCUCU | AGAGCGGUU GGAGCCUG |
| 4844 | GCCAGCAC CUGAUGA X GAA AUGCAUCU | AGAUGCAUU GUGCUGGC |
| 4854 | CUCCACCA CUGAUGA X GAA AGCCAGCA | UGCUGGCUC UGGUGGAG |
| 4870 | CAGGCCAC CUGAUGA X GAA AGCCCACC | GGUGGGCUU GUGGCCUG |
| 4880 | CGUUUCCU CUGAUGA X GAA ACAGGCCA | UGGCCUGUC AGGAAACG |
| 4908 | CAAAACCA CUGAUGA X GAA ACCCUGCC | GGCAGGGUU UGGUUUUG |
| 4909 | CCAAAACC CUGAUGA X GAA AACCCUGC | GCAGGCUUU GGUUUUGG |
| 4913 | CCUUCCAA CUGAUGA X GAA ACCAAACC | GGUUUGGUU UUGGAAGG |
| 4914 | ACCUUCCA CUGAUGA X GAA AACCAAAC | GUUUGGUUU UGGAAGGU |
| 4915 | AACCUUCC CUGAUGA X GAA AAACCAAA | UUUGGGUUU GGAAGGUU |
| 4923 | AGCACGCA CUGAUGA X GAA ACCUUCCA | UGGAAGGUU UGCGUGCU |
| 4924 | GAGCACGC CUGAUGA X GAA AACCUUCC | GGAAGGUUU GCGUGCUC |
| 4932 | ACUGUGAA CUGAUGA X GAA AGCACGCA | UGCGUGCUC UUCACAGU |
| 4934 | CGACUGUG CUGAUGA X GAA AGAGCACG | CGUGCUCUU CACAGUCG |
| 4935 | CCGACUGU CUGAUGA X GAA AAGAGCAC | GUGCUCUUC ACAGUCGG |
| 4941 | UGUAACCC CUGAUGA X GAA ACUGUGAA | UUCACAGUC GGGUUACA |
| 4946 | UCGCCUGU CUGAUGA X GAA ACCCGACU | AGUCGGGUU ACAGGCGA |
| 4947 | CUCGCCUG CUGAUGA X GAA AACCCGAC | GUCGGGUUA CAGGCGAG |
| 4957 | CCACAGGG CUGAUGA X GAA ACUCGCCU | AGGCGAGUU CCCUGUGG |
| 4958 | GCCACAGG CUGAUGA X GAA AACUCGCC | GGCGAGUUC CCUGUGGC |
| 4969 | GAGUAGGA CUGAUGA X GAA ACGCCACA | UGUGGCGUU UCCUACUC |
| 4970 | GGAGUAGG CUGAUGA X GAA AACGCCAC | GUGGCGUUU CCUACUCC |
| 4971 | AGGAGUAG CUGAUGA X GAA AAACGCCA | UGGCGUUUC CUACUCCU |

TABLE VI-continued

Mouse flk-1 VEGF Receptor-Hammerhead Ribozyme and Substrate sequence

| nt. Position | HH Ribozyme Sequence | Substrate |
|---|---|---|
| 4974 | AUUAGGAG CUGAUGA X GAA AGGAAACG | CGUUUCCUA CUCCUAAU |
| 4977 | CUCAUUAG CUGAUGA X GAA AGUAGGAA | UUCCUACUC CUAAUGAG |
| 4980 | ACUCUCAU CUGAUGA X GAA AGGAGUAG | CUACUCCUA AUGAGAGU |
| 4989 | CCGGAAGG CUGAUGA X GAA ACUCUCAU | AUGAGAGUU CCUUCCGG |
| 4990 | UCCGGAAG CUGAUGA X GAA AACUCUCA | UGAGAGUUC CUUCCGGA |
| 4993 | GAGUCCGG CUGAUGA X GAA AGGAACUC | GAGUUCCUU CCGGACUC |
| 4994 | AGAGUCCG CUGAUGA X GAA AAGGAACU | AGUUCCUUC CGGACUCU |
| 5001 | ACACGUAA CUGAUGA X GAA AGUCCGGA | UCCGGACUC UUACGUGU |
| 5003 | AGACACGU CUGAUGA X GAA AGAGUCCG | CGGACUCUU ACGUGUCU |
| 5004 | GAGACACG CUGAUGA X GAA AAGAGUCC | GGACUCUUA CGUGUCUC |
| 5010 | GGCCAGGA CUGAUGA X GAA ACACGUAA | UUACGUGUC UCCUGGCC |
| 5012 | CAGGCCAG CUGAUGA X GAA AGACACGU | ACGUGUCUC CUGGCCUG |
| 5046 | GAAGGAGC CUGAUGA X GAA AGCUGCAU | AUGCAGCUU GCUCCUUC |
| 5050 | UGAGGAAG CUGAUGA X GAA AGCAAGCU | AGCUUGCUC CUUCCUCA |
| 5053 | AGAUGAGG CUGAUGA X GAA AGGAGCAA | UUGCUCCUU CCUCAUCU |
| 5054 | GAGAUGAG CUGAUGA X GAA AAGGAGCA | UGCUCCUUC CUCAUCUC |
| 5057 | UGAGAGAU CUGAUGA X GAA AGGAAGGA | UCCUUCCUC AUCUCUCA |
| 5060 | GCCUGAGA CUGAUGA X GAA AUGAGGAA | UUCCUCAUC UCUCGGGC |
| 5062 | CAGCCUGA CUGAUGA X GAA AGAUGAGG | CCUCAUCUC UCAGGCUG |
| 5064 | CACAGCCU CUGAUGA X GAA AGAGAUGA | UCAUCUCUC AGGCUGUG |
| 5076 | UCUGAAUU CUGAUGA X GAA AGGCACAG | CUGUGCCUU AAUUCAGA |
| 5077 | UUCUGAAU CUGAUGA X GAA AAGGCACA | UGUGCCUUA AUUCAAAA |
| 5080 | GUGUUCUG CUGAUGA X GAA AUUAAGGC | GCCUUAAUU CAGAACAC |
| 5081 | GGUGUUCU CUGAUGA X GAA AAUUAAGG | CCUUAAUUC AGAACACC |
| 5105 | CCUCUGCC CUGAUGA X GAA ACGUUCCU | AGGAACGUC GGCAGAGG |
| 5116 | CCCGUCAG CUGAUGA X GAA AGCCUCUG | CAGAGGCUC CUGACGGG |
| 5135 | GUUCUCAC CUGAUGA X GAA AUUCUUCG | CGAAGAAUU GUGAGAAC |
| 5156 | GAAACCCU CUGAUGA X GAA AGUUUCUG | CAGAAACUC AGGGUUUC |
| 5162 | CCAGCAGA CUGAUGA X GAA ACCCUGAG | CUCAGGGUU UCUGCUGG |
| 5163 | CCCAGCAG CUGAUGA X GAA AACCCUGA | UCAGGGUUU CUGCUGGG |
| 5164 | ACCCAGCA CUGAUGA X GAA AAACCCUG | CAGGGUUUC UGCUGGGU |
| 5203 | AACCCUCA CUGAUGA X GAA ACCUGCCA | UGGCAGGUC UGAGGGUU |
| 5211 | UGACAGAG CUGAUGA X GAA ACCCUCAG | CUGAGGGUU CUCUGUCA |
| 5212 | UGGACAGA CUGAUGA X GAA AACCCUCA | UGAGGGUUC UCUGUCAA |
| 5214 | ACUGGACA CUGAUGA X GAA AGAACCCU | AGGGUUCUC UGUCAAGU |
| 5218 | CGCCACUU CUGAUGA X GAA ACAGAGAA | UUCUCUGUC AAGUGGCG |
| 5229 | UGAGCCUU CUGAUGA X GAA ACCGCCAC | GUGGCGGUA AAGGCUCA |

TABLE VI-continued

Mouse flk-1 VEGF Receptor-Hammerhead Ribozyme and Substrate sequence

| nt. Position | HH Ribozyme Sequence | Substrate |
|---|---|---|
| 5236 | ACCAGCCU CUGAUGA X GAA AGCCUUUA | UAAAGGCUC AGGCUGGU |
| 5247 | AGAGGAAG CUGAUGA X GAA ACACCAGC | GCUGGUGUU CUUCCUCU |
| 5248 | UAGAGGAA CUGAUGA X GAA AACACCAG | CUGGUGUUC UUCCUCUA |
| 5250 | GAUAGAGG CUGAUGA X GAA AGAACACC | GGUGUUCUU CCUCUAUC |
| 5251 | AGAUAGAG CUGAUGA X GAA AAGAACAC | GUGUUCUUC CUCUAUCU |
| 5254 | UGGAGAUA CUGAUGA X GAA AGGAAGAA | UUCUUCCUC UAUCUCCA |
| 5256 | AGUGGAGA CUGAUGA X GAA AGAGGAAG | CUUCCUCUA UCUCCACU |
| 5258 | GGAGUGGA CUGAUGA X GAA AUAGAGGA | UCCUCUAUC UCCACUCC |
| 5260 | CAGGAGUG CUGAUGA X GAA AGAUAGAG | CUCUAUCUC CACUCCUG |
| 5265 | CCUGACAG CUGAUGA X GAA AGUGGAGA | UCUCCACUC CUGUCAGG |
| 5270 | GGGGGCCU CUGAUGA X GAA ACAGGAGU | ACUCCUGUC AGGCCCCC |
| 5283 | AUACUGAG CUGAUGA X GAA ACUUGGGG | CCCCAAGUC UCACAUAU |
| 5286 | AAAAUACU CUGAUGA X GAA AGGACUUG | CAAGUCCUC AGUAUUUU |
| 5290 | AGCUAAAA CUGAUGA X GAA ACUGAGGA | UCCUCAGUA UUUUAGCU |
| 5292 | AAAGCUAA CUGAUGA X GAA AUACUGAG | CUCAGUAUU UUAGCUUU |
| 5293 | CAAAGCUA CUGAUGA X GAA AAUACUGA | UCAGUAUUU UAGCUUUG |
| 5294 | ACAAAGCU CUGAUGA X GAA AAAUACUG | CAGUAUUUU AGCUUUGU |
| 5295 | CAGAAAGC CUGAUGA X GAA AAAAUACU | AGUAUUUUA GCUUUGUG |
| 5299 | AAGCCACA CUGAUGA X GAA AGCUAAAA | UUUUAGCUU UGUGGCUU |
| 5300 | GAAGCCAC CUGAUGA X GAA AAGCUAAA | UUUAGCUUU GUGGUUUC |
| 5307 | CCAUCAGG CUGAUGA X GAA AGCCACAA | UUGUGGCUU CCUGAUGG |
| 5308 | GCCAUCAG CUGAUGA X GAA AAGCCACA | UGUGGCUUC CUGAUGGC |
| 5325 | CCAAUUAA CUGAUGA X GAA AUUUUUCU | AGAAAAAUC UUAAUUGG |
| 5327 | AACCAAUU CUGAUGA X GAA AGAUUUUU | AAAAAUCUU AAUUGGUU |
| 5328 | CAACCAAU CUGAUGA X GAA AAGAUUUU | AAAAUCUUA AUUGGUUG |
| 5331 | AACCAACC CUGAUGA X GAA AUUAAGAU | AUCUUAAUU GGUUGGUU |
| 5335 | AGCAAACC CUGAUGA X GAA ACCAAUUA | UAAUUGGUU GCUUUGCU |
| 5339 | GGAGAGCA CUGAUGA X GAA ACCAACCA | UGGUUGGUU UGCUCUCC |
| 5340 | UGGAGAGC CUGAUGA X GAA AACCAACC | GGUUGGUUU GCUCUCCA |
| 5344 | UAUCUGGA CUGAUGA X GAA AGCAAACC | GGUUUGCUC UCCAGAUA |
| 5346 | AUUAUCUG CUGAUGA X GAA AGAGCAAA | UUUGCUCUC CAGAUAAU |
| 5352 | CUAGUGAU CUGAUGA X GAA AUCUGGAG | CUCCAGAUA AUCACUAG |
| 5355 | UGGCUAGU CUGAUGA X GAA AUUAUCUG | CAGAUAAUC ACUAGCCA |
| 5359 | AAUCUGGC CUGAUGA X GAA AGUGAUUA | UAAUCACUA GCCAGAUU |
| 5367 | AAUUUCGA CUGAUGA X GAA AUCUGGCU | AGCCAGAUU UCGAAAUU |
| 5368 | UAAUUUCG CUGAUGA X GAA AAUCUGGC | GCCAGAUUU CGAAAUUA |
| 5369 | GUAAUUUC CUGAUGA X GAA AAAUCUGG | CCAGAUUUC GAAAUUAC |

TABLE VI-continued

Mouse flk-1 VEGF Receptor-Hammerhead Ribozyme and Substrate sequence

| nt. Position | HH Ribozyme Sequence | Substrate |
|---|---|---|
| 5375 | UAAAAAGU CUGAUGA X GAA AUUUCGAA | UUCGAAAUU ACUUUUUA |
| 5376 | CUAAAAAG CUGAUGA X GAA AAUUUCGA | UCGAAAUUA CUUUUUAG |
| 5379 | CGGCUAAA CUGAUGA X GAA AGUAAUUU | AAAUUACUU UUUAGCCG |
| 5380 | UCGGCUAA CUGAUGA X GAA AAGUAAUU | AAUUACUUU UUAGCCGA |
| 5381 | CUCGGCUA CUGAUGA X GAA AAAGUAAU | AUUACUUUU UAGCCGAG |
| 5382 | CCUCGGCU CUGAUGA X GAA AAAAGUAA | UUACUUUUU AGCCGAGG |
| 5383 | ACCUCGGC CUGAUGA X GAA AAAAAGUA | UACUUUUUA GCCGAGGU |
| 5392 | GUUAUCAU CUGAUGA X GAA ACCUCGGC | GCCGAGGUU AUGAUAAC |
| 5393 | UGUUAUCA CUGAUGA X GAA AACCUCGG | CCGAGGUUA UGAUAACA |
| 5398 | GUAGAUGU CUGAUGA X GAA AUCAUAAC | GUUAUGAUA ACAUCUAC |
| 5403 | AUACAGUA CUGAUGA X GAA AUGUUAUC | GAUAACAUC UACUGUAU |
| 5405 | GGAUACAG CUGAUGA X GAA AGAUGUUA | UAACAUCUA CUGUAUCC |
| 5410 | CUAAAGGA CUGAUGA X GAA ACAGUAGA | UCUACUGUA UCCUUUAG |
| 5412 | UUCUAAAG CUGAUGA X GAA AUACAGUA | UACUGUAUC CUUUAGAA |
| 5415 | AAAUUCUA CUGAUGA X GAA AGGAUACA | UGUAUCCUU UAGAAUUU |
| 5416 | AAAAUUCU CUGAUGA X GAA AAGGAUAC | GUAUCCUUU AGAAUUUU |
| 5417 | UAAAAUUC CUGAUGA X GAA AAAGGAUA | UAUCCUUUA GAAUUUUA |
| 5422 | UAGGUUAA CUGAUGA X GAA AUUCUAAA | UUUAAAAUU UUAACCUA |
| 5423 | AUAGGUUA CUGAUGA X GAA AAUUCUAA | UUAGAAUUU UAACCWU |
| 5424 | UAUAGGUU CUGAUGA X GAA AAAUUCUA | UAGAAUUUU AACCUAUA |
| 5425 | UUAUAGGU CUGAUGA X GAA AAAAUUCU | AGAAUUUUA ACCUAUAA |
| 5430 | UAGUUUGA CUGAUGA X GAA AGGUUAAA | UUUAACCUA UAAAACUA |
| 5432 | CAUAGUUU CUGAUGA X GAA AUAGGUGA | UAACCUAUA AAACUAUG |
| 5438 | AGUAGACA CUGAUGA X GAA AGUUUUAU | AUAAAACUA UGUCUACU |
| 5442 | AACCAGUA CUGAUGA X GAA ACAUAGUU | AACUAUGUC UACUGGUU |
| 5444 | GAAACCAG CUGAUGA X GAA AGACAUAG | CUAUGUCUA CUGGUUUC |
| 5450 | CAGGCAGA CUGAUGA X GAA ACCAGUAG | CUACUGGUU UCUGCCUG |
| 5451 | ACAGGCAG CUGAUGA X GAA AACCAGUA | UACUGGUUU CUGCCUGU |
| 5452 | CACAGGCA CUGAUGA X GAA AAACCAGU | ACUGGUUUC UGCCUGUG |

Where "X" represents stem II region of a HH ribozyme (Hertel et al., 1992 Nucleic Acids Res. 20 3252). The length of stem II may be ≧2 base-pairs.

TABLE VII

Mouse flk-1 VEGF receptor-Hairpin Ribozyme and Substrate Sequences

| nt. Position | HP Ribozyme Sequences | Substrate |
|---|---|---|
| 74 | GGGACACA AGAA GGGCCC ACCAGAGAAACACACGUUGUGGUACAUUACCUGGUA | GGGCCCA GAC UGUGUCCC |
| 88 | GUUAUCCC AGAA GCGGGA ACCAGAGAAACACACGUUGUGGUACAUUACCUGGUA | UCCCGCA GCC GGGAUAAC |

TABLE VII-continued

Mouse flk-1 VEGF receptor-Hairpin Ribozyme and Substrate Sequences

| nt. Position | HP Ribozyme Sequences | Substrate |
|---|---|---|
| 105 | GGAAUCGG AGAA GCCAGG ACCAGAGAAACACACGUUGUGGUACAUUACCUGGUA | CCUGGCU GAC CCGAUUCC |
| 110 | UCCGCGGA AGAA GGUCAG ACCAGAGAAACACACGUUGUGGUACAUUACCUGGUA | CUGACCC GAU UCCGCGGA |
| 125 | CGGCUGUC AGAA GUGUCC ACCAGAGAAACACACGUUGUGGUACAUUACCUGGUA | GGACACC GCU GACAGCCG |
| 132 | CCAGCCGC AGAA GUCAGC ACCAGAGAAACACACGUUGUGGUACAUUACCUGGUA | GCUGACA GCC GCGGCUGG |
| 138 | CUGGCUCC AGAA GCGGCU ACCAGAGAAACACACGUUGUGGUACAUUACCUGGUA | AGCCGCG GCU GGAGCCAG |
| 175 | CAGCGCAA AGAA GGGGAG ACCAGAGAAACACACGUUGUGGUACAUUACCUGGUA | CUCCCCG GUC UUGCGCUG |
| 199 | GUCACAGA AGAA GUAUGG ACCAGAGAAACACACGUUGUGGUACAUUACCUGGUA | CCAUACC GCC UCUGUGAC |
| 309 | CACAGAGC AGAA GCUAGC ACCAGAGAAACACACGUUGUGGUACAUUACCUGGUA | GCUAGCU GUC GCUCUGUG |
| 342 | CCCACAGA AGAA GCUCGG ACCAGAGAAACACACGUUGUGGUACAUUACCUGGUA | CCGAGCC GCC UCUGUGGG |
| 434 | UGCAAGUA AGAA GAAGGG ACCAGAGAAACACACGUUGUGGUACAUUACCUGGUA | CCCUUCA GAU UACUUGCA |
| 630 | UAGACAUA AGAA GUGGAG ACCAGAGAAACACACGUUGUGGUACAUUACCUGGUA | CUCCACU GUU UAUGUCUA |
| 655 | GAAUGGUG AGAA GUAAUC ACCAGAGAAACACACGUUGUGGUACAUUACCUGGUA | GAUUACA GAU CACCAUUC |
| 739 | CGACCCUC AGAA GGGGAU ACCAGAGAAACACACGUUGUGGUACAUUACCUGGUA | AUCCCCU GCC GAGGGUCG |
| 807 | CUGUUUCC AGAA GGAACA ACCAGAGAAACACACGUUGUGGUACAUUACCUGGUA | UGUUCCG GAU GGAAACAG |
| 920 | ACAUGAUA AGAA GAUAGG ACCAGAGAAACACACGUUGUGGUACAUUACCUGGUA | CCUAUCA GUC UAUCAUGU |
| 1002 | UUUUCUCC AGAA GAUAGC ACCAGAGAAACACACGUUGUGGUACAUUACCUGGUA | GCUAUCU GCC GGAGAAAA |
| 1229 | UCUUGAUC AGAA GUCCAC ACCAGAGAAACACACGUUGUGGUACAUUACCUGGUA | GUGGACG GAU GAUCAAGA |
| 1365 | AUAUCAGG AGAA GGGUAA ACCAGAGAAACACACGUUGUGGUACAUUACCUGGUA | UUACCCA GCU CCUGAUAU |
| 1556 | UCUCACCG AGAA GGGGUG ACCAGAGAAACACACGUUGUGGUACAUUACCUGGUA | CACCCCA GAU CGGUGAGA |
| 1629 | UUGGCGUA AGAA GUGCAU ACCAGAGAAACACACGUUGUGGUACAUUACCUGGUA | AUGCACA GUC UACGCCAA |
| 1687 | UCUGUAGG AGAA GGCUUC ACCAGAGAAACACACGUUGUGGUACAUUACCUGGUA | GAAGCCU GCU CCUACAGA |
| 1696 | UUGGCCGG AGAA GUAGGA ACCAGAGAAACACACGUUGUGGUACAUUACCUGGUA | UCCUACA GAC CCGGCCAA |
| 1796 | UUCCUUCA AGAA GGGCAU ACCAGAGAAACACACGUUGUGGUACAUUACCUGGUA | AUGCCCU GAU UGAAGGAA |
| 1950 | GGCUGGGC AGAA GGUUGC ACCAGAGAAACACACGUUGUGGUACAUUACCUGGUA | GCAACCU GCU GCCCAGCC |
| 1953 | GUUGGCUG AGAA GCAGGU ACCAGAGAAACACACGUUGUGGUACAUUACCUGGUA | ACCUGCU GCC CAGCCAAC |
| 1985 | CAGUGCAC AGAA GGGACA ACCAGAGAAACACACGUUGUGGUACAUUACCUGGUA | UGUCCCU GUU GUGCACUG |
| 2055 | CCCAUGUG AGAA GAUGUU ACCAGAGAAACACACGUUGUGGUACAUUACCUGGUA | AACAUCG GUC CACAUGGG |
| 2082 | UUCUUGCA AGAA GGUGUG ACCAGAGAAACACACGUUGUGGUACAUUACCUGGUA | CACACCA GUU UGCAAGAA |
| 2208 | UUAUCUUG AGAA GAGCAA ACCAGAGAAACACACGUUGUGGUACAUUACCUGGUA | UUGCUCU GCU CAAGAUAA |
| 2252 | GGAUGAUG AGAA GUUUGA ACCAGAGAAACACACGUUGUGGUACAUUACCUGGUA | UCAAACA GCU CAUCAUCC |
| 2444 | UGCGGAUA AGAA GGUUCC ACCAGAGAAACACACGUUGUGGUACAUUACCUGGUA | GGAACCU GAC UAUCCGCA |
| 2639 | GCUUAACG AGAA GUAGGA ACCAGAGAAACACACGUUGUGGUACAUUACCUGGUA | UCCUACG GAC CGUUAAGC |
| 2703 | GGCAAUUC AGAA GGAUCC ACCAGAGAAACACACGUUGUGGUACAUUACCUGGUA | GGAUCCA GAU GAAUUGCC |
| 2777 | CUAGUUUC AGAA GGUCCC ACCAGAGAAACACACGUUGUGGUACAUUACCUGGUA | GGGACCG GCU GAAACUAG |
| 2832 | CCAAAAGC AGAA GCCUCA ACCAGAGAAACACACGUUGUGGUACAUUACCUGGUA | UGAGGCA GAC GCUUUUGG |
| 3199 | AAAGCCUG AGAA GGCAGA ACCAGAGAAACACACGUUGUGGUACAUUACCUGGUA | UCUGCCA GCU CAGCCUUU |
| 3278 | GCUCCAAG AGAA GGAAGU ACCAGAGAAACACACGUUGUGGUACAUUACCUGGUA | ACUUCCU GAC CUUGGAGC |

TABLE VII-continued

Mouse flk-1 VEGF receptor-Hairpin Ribozyme and Substrate Sequences

| nt. Position | HP Ribozyme Sequences | Substrate |
|---|---|---|
| 3304 | CACUUGGA AGAA GUAACA ACCAGAGAAACACACGUUGUGGUACAUUACCUGGUA | UGUUACA GCU UCCAAGUG |
| 3421 | CCGGGCCA AGAA GAAGUC ACCAGAGAAACACACGUUGUGGUACAUUACCUGGUA | GACUUCG GCU UGGCCCGG |
| 3450 | CUGACAUA AGAA GGGUCU ACCAGAGAAACACACGUUGUGGUACAUUACCUGGUA | AGACCCG GAU UAUGUCAG |
| 3475 | CAAAGGGA AGAA GGCAUC ACCAGAGAAACACACGUUGUGGUACAUUACCUGGUA | GAUGCCC GAC UCCCUUUG |
| 3663 | GUAGUGUA AGAA GGAGCC ACCAGAGAAACACACGUUGUGGUACAUUACCUGGUA | GGCUCCU GAC UACACUAC |
| 3689 | CCAGCAUG AGAA GGUACA ACCAGAGAAACACACGUUGUGGUACAUUACCUGGUA | UGUACCA GAC CAUGCUGG |
| 3703 | CUCAUGCC AGAA GUCCAG ACCAGAGAAACACACGUUGUGGUACAUUACCUGGUA | CUGGACU GCU GGCAUGAG |
| 3860 | GUGAGGUA AGAA GGGAGA ACCAGAGAAACACACGUUGUGGUACAUUACCUGGUA | UCUCCCU GCC UACCUCAC |
| 3873 | AUACAGGA AGAA GGUGAG ACCAGAGAAACACACGUUGUGGUACAUUACCUGGUA | CUCACCU GUU UCCUGUAU |
| 4038 | UGGCUGUC AGAA GGGAUC ACCAGAGAAACACACGUUGUGGUACAUUACCUGGUA | GAUCCCA GAU GACAGCCA |
| 4181 | AGCCACUG AGAA GGUUGG ACCAGAGAAACACACGUUGUGGUACAUUACCUGGUA | CCAACCA GAC CAGUGGCU |
| 4196 | GAUACCCA AGAA GGUAGC ACCAGAGAAACACACGUUGUGGUACAUUACCUGGUA | GCUACCA GUC UGGGUAUC |
| 4212 | UCUGUGUC AGAA GAGUGA ACCAGAGAAACACACGUUGUGGUACAUUACCUGGUA | UCACUCA GAU GACACAGA |
| 4278 | UCAGCGUG AGAA GCAGCA ACCAGAGAAACACACGUUGUGGUACAUUACCUGGUA | UGCUGCA GUU CACGCUGA |
| 4287 | GUCCCUGA AGAA GCGUGA ACCAGAGAAACACACGUUGUGGUACAUUACCUGGUA | UCACGCU GAC UCAGGGAC |
| 4307 | AGGAGGUG AGAA GCAGUG ACCAGAGAAACACACGUUGUGGUACAUUACCUGGUA | CACUGCA GCU CACCUCCU |
| 4318 | UCCAUUUA AGAA GGAGGU ACCAGAGAAACACACGUUGUGGUACAUUACCUGGUA | ACCUCCU GUU UAAAUGGA |
| 4338 | GGAGCCGG AGAA GGACCA ACCAGAGAAACACACGUUGUGGUACAUUACCUGGUA | UGGUCCU GUC CCGGCUCC |
| 4344 | GGGGGCGG AGAA GGGACA ACCAGAGAAACACACGUUGUGGUACAUUACCUGGUA | UGUCCCG GCU CCGCCCCC |
| 4349 | GAGUUGGG AGAA GAGCCG ACCAGAGAAACACACGUUGUGGUACAUUACCUGGUA | CGGGUCC GCC CCCAACUC |
| 4383 | AAAAUCUA AGAA GCACCU ACCAGAGAAACACACGUUGUGGUACAUUACCUGGUA | AGGUGCU GCU UAGAUUUU |
| 4462 | UCCUUGCA AGAA GAGGUC ACCAGAGAAACACACGUUGUGGUACAUUACCUGGUA | GACCUCA GAC UGCAAGGA |
| 4574 | GAGACCAC AGAA GGGCAC ACCAGAGAAACACACGUUGUGGUACAUUACCUGGUA | GUGCCCU GCU GUGGUCUC |
| 4626 | UCUUGGAG AGAA GAGUCC ACCAGAGAAACACACGUUGUGGUACAUUACCUGGUA | GGACUCU GUC CUCCAAGA |
| 4723 | CCAAGGUA AGAA GACUCG ACCAGAGAAACACACGUUGUGGUACAUUACCUGGUA | CGAGUCU GUC UACCUUGG |
| 4823 | CAGGCUCC AGAA GCUCUC ACCAGAGAAACACACGUUGUGGUACAUUACCUGGUA | GAGAGCG GUU GGAGCCUG |
| 4836 | CACAAUGC AGAA GCAGGC ACCAGAGAAACACACGUUGUGGUACAUUACCUGGUA | GCCUGCA GAU GCAUUGUG |
| 4896 | ACCCUGCC AGAA GCCUUU ACCAGAGAAACACACGUUGUGGUACAUUACCUGGUA | AAAGGCG GCC GGCAGGGU |
| 4938 | UGUAACCC AGAA GUGAAG ACCAGAGAAACACACGUUGUGGUACAUUACCUGGUA | CUUCACA GUC GGGUUACA |
| 4996 | ACGUAAGA AGAA GGAAGG ACCAGAGAAACACACGUUGUGGUACAUUACCUGGUA | CCUUCCG GAC UCUUACGU |
| 5042 | AAGGAGCA AGAA GCAUCA ACCAGAGAAACACACGUUGUGGUACAUUACCUGGUA | UGAUGCA GCU UGCUCCUU |
| 5118 | UCGGCCCC AGAA GGAGCC ACCAGAGAAACACACGUUGUGGUACAUUACCUGGUA | GGCUCCU GAC GGGGCCGA |
| 5165 | CUCCACCC AGAA GAAACC ACCAGAGAAACACACGUUGUGGUACAUUACCUGGUA | G(GGJCU GCU CGGUGGAG |
| 5310 | UUUCUGCC AGAA GGAAGC ACCAGAGAAACACACGUUGUGGUACAUUACCUGGUA | GCUUCCU GAU GGCAGAAA |
| 5363 | AUUUCGAA AGAA GGCUAG ACCAGAGAAACACACGUUGUGGUACAUUACCUGGUA | CUAGCCA GAU UUCGAAAU |
| 5453 | AGCACACA AGAA GAAACC ACCAGAGAAACACACGUUGUGGUACAUUACCUGGUA | GGUUUCU GCC UGUGUGGU |

Table VIII

Mouse flt-1 VEGF Receptor-Hammerhead Ribozyme and Substrate Sequence

| nt. Position | HH Ribozyme | Substrate |
|---|---|---|
| 17 | GUGAGCAA CUGAUGU X GAA ACGCGGCC | GGCCGCGUC UUGCUCAC |
| 19 | UGGUGAGC CUGAUGU X GAA AGACGCGG | CCGCGUCUU GCUCACCA |
| 23 | ACCAUGGU CUGAUGU X GAA AGCAAGAC | GUCUUGCUC ACCAUGGU |
| 32 | CAGCAGCU CUGAUGU X GAA ACCAUGGU | ACCAUGGUC AGCUGCUG |
| 53 | UAAGGCAA CUGAUGU X GAA ACCGCGGU | ACCGCGGUC UUGCCUUA |
| 55 | CGUAAGGC CUGAUGU X GAA AGACCGCG | CGCGGUCUU GCCUUACG |
| 60 | CAGCGCGU CUGAUGU X GAA AGGCAAGA | UCUUGCCUU ACGCGCUG |
| 61 | GCAGCGCG CUGAUGU X GAA AAGGCAAG | CUUGCCUUA CGCGCUGC |
| 71 | AGACACCC CUGAUGU X GAA AGCAGCGC | GCGCUGCUC GGGUGUCU |
| 78 | GAGAAGCA CUGAUGU X GAA ACACCCGA | UCGGGUGUC UGCUUCUC |
| 83 | CCUGUGAG CUGAUGU X GAA AGCAGACA | UGUCUGCUU CUCACAGG |
| 84 | UCCUGUGA CUGAUGU X GAA AAGCAGAC | GUCUGCUUC UCACAGGA |
| 86 | UAUCCUGU CUGAUGU X GAA AGAAGCAG | CUGCUUCUC ACAGGAUA |
| 94 | CUGAGCCA CUGAUGU X GAA AUCCUGUG | CACAGGAUA UGGCUCAG |
| 100 | UCGACCCU CUGAUGU X GAA AGCCAUAU | AUAUGGCUC AGGGUCGA |
| 106 | UUAACUUC CUGAUGU X GAA ACCCUGAG | CUCAGGGUC GAAGUUAA |
| 112 | GCACUUUU CUGAUGU X GAA ACUUCGAC | GUCGAAGUU AAAAGUGC |
| 113 | GGCACUUU CUGAUGU X GAA AACUUCGA | UCGAAGUUA AAAGUGCC |
| 132 | GCCUUUUA CUGAUGU X GAA ACUCAGUU | AACUGAGUU UAAAAGGC |
| 133 | UGCCUUUU CUGAUGU X GAA AACUCAGU | ACUGAGUUU AAAAGGCA |
| 134 | GUGCCUUU CUGAUGU X GAA AAACUCAG | CUGAGUUUA AAAGGCAC |
| 152 | GCUUGCAU CUGAUGU X GAA ACAUGCUG | CAGCAUGUC AUGCAAGC |
| 171 | GAGAAAGA CUGAUGU X GAA AGUCUGGC | GCCAGACUC UCUUUCUC |
| 173 | UUGAGAAA CUGAUGU X GAA AGAGUCUG | CAGACUCUC UUUCUCAA |
| 175 | ACUUGAGA CUGAUGU X GAA AGAGAGUC | GACUCUCUU UCUCAAGU |
| 176 | CACUUGAG CUGAUGU X GAA AAGAGAGU | ACUCUCUUU CUCAAGUG |
| 177 | GCACUUGA CUGAUGU X GAA AAAGAGAG | CUCUCUUUC UCAAGUGC |
| 179 | CUGCACUU CUGAUGU X GAA AGAAAGAG | CUCUUUCUC AAGUGCAG |
| 205 | GAGACCAU CUGAUGU X GAA AGUGGGCU | AGCCCACUC AUGGUCUC |
| 211 | UGGGCAGA CUGAUGU X GAA ACCAUGAG | CUCAUGGUC UCUGCCCA |
| 213 | CGUGGGCA CUGAUGU X GAA AGACCAUG | CAUGGUCUC UGCCCACG |
| 254 | GGGGGAGU CUGAUGU X GAA AUGCUCAG | CUGAGCAUC ACUCCCCC |
| 258 | CGAUGGGG CUGAUGU X GAA AGUGAUGC | GCAUCACUC CCCAUCG |
| 265 | CACAGGCC CUGAUGU X GAA AUGGGGGA | UCCCCCAUC GGCCUGUG |
| 282 | UUGCCUGU CUGAUGU X GAA AUCCCUCC | GGAGGGAUA ACAGGCAA |
| 292 | UGCUGCAG CUGAUGU X GAA AUUGCCUG | CAGGCAAUU CUGCAGCA |
| 293 | GUGCUGCA CUGAUGU X GAA AAUUGCCU | ACCCAAUUC UGCAGCAC |

Table VIII-continued

Mouse flt-1 VEGF Receptor-Hammerhead Ribozyme and Substrate Sequence

| nt. Position | HH Ribozyme | Substrate |
|---|---|---|
| 304 | CCAAGGUC CUGAUGU X GAA AGGUGCUG | CAGCACCUU GACCUUGG |
| 310 | CCGUGUCC CUGAUGU X GAA AGGUCAAG | CUUGACCUU GGACACGG |
| 341 | CAGGUGUA CUGAUGU X GAA AGGCCCGU | ACGGGCCUC UACACCUG |
| 343 | UACAGGUG CUGAUGU X GAA AGAGGCCC | GGGCCUCUA CACCUGUA |
| 351 | GAGGUAUC CUGAUGU X GAA ACAGGUGU | ACACCUGUA GAUACCUC |
| 355 | UAGGGAGG CUGAUGU X GAA AUCUACAG | CUGUAGAUC CCUCCCUA |
| 359 | GAUGUAGG CUGAUGU X GAA AGGUAUCU | AGAUACCUC CUACAUC |
| 363 | AGUAGAUG CUGAUGU X GAA AGGGAGGU | ACCUCCCUA CAUCUACU |
| 367 | UCGAAGUA CUGAUGU X GAA AUGUAGGG | CCCUACAUC UACUUCGA |
| 369 | CUUCGAAG CUGAUGU X GAA AGAUGUAG | CUACAUCUA CUUCGAAG |
| 372 | UUUCUUCG CUGAUGU X GAA AGUAGAUG | CAUCUACUU CGAAGAAA |
| 373 | UUUUCUUC CUGAUGU X GAA AAGUAGAU | AUCUACUUC GAAGAAAA |
| 394 | AGAUUGAA CUGAUGU X GAA AUUCCGCU | AGCGGAAUC UUCAAUCU |
| 396 | GUAGAUUG CUGAUGU X GAA AGAUUCCG | CGGAAUCUU CAAUCUAC |
| 397 | UGUAGAUU CUGAUGU X GAA AAGAUUCC | GGAAUCUUC AAUCUACA |
| 401 | AAUAUGUA CUGAUGU X GAA AUUGAAGA | UCUUCAAUC UACAUAUU |
| 403 | CAAAUAUG CUGAUGU X GAA AGAUUGAA | UUCAAUCUA CAUAUUUG |
| 407 | CUAACAAA CUGAUGU X GAA AUGUAGAU | AUCUACAUA UUUGUUAG |
| 409 | CACUAACA CUGAUGU X GAA AUAUGUAG | CUACAUAUU UGUUAGUG |
| 410 | UCACUAAC CUGAUGU X GAA AAUAUGUA | UACAUAUUU GUUAGUGA |
| 413 | GCAUCACU CUGAUGU X GAA ACAAAUAU | AUAUUUGUU AGUGAUGC |
| 414 | UGCAUCAC CUGAUGU X GAA AACAAAUA | UAUUUGUUA GUGAUGCA |
| 429 | UAUGAAAG CUGAUGU X GAA ACUCCCUG | CAGGGAGUC CUUUCAUA |
| 432 | CUCUAUGA CUGAUGU X GAA AGGACUCC | GGAGUCCUU UCAUAGAG |
| 433 | UCUCUAUG CUGAUGU X GAA AAGGACUC | GAGUCCUUU CAUAGAGA |
| 434 | AUCUCUAU CUGAUGU X GAA AAAGGACU | AGUCCUUUC AUAGAGAU |
| 437 | UGCAUCUC CUGAUGU X GAA AUGAAAGG | CCUUUCAUA GAGAUGCA |
| 455 | AGUUUGGG CUGAUGU X GAA AUGUCAGU | ACUGACAUA CCCAAACU |
| 464 | AUGUGCAC CUGAUGU X GAA AGUUUGGG | CCCAAACUU GUGCACAU |
| 491 | GGGAUGAU CUGAUGU X GAA AGCUGUCU | AGACAGCUC AUCAUCCC |
| 494 | CAGGGAU CUGAUGU X GAA AUGAGCUC | CAGCUCAUC AUCCCUG |
| 497 | CGGCAGGG CUGAUGU X GAA AUGAUGUG | CUCAUCAUC CCUGCCG |
| 514 | CGUGGGU CUGAUGU X GAA ACGUCACC | GGUGACGUC ACCCAACG |
| 524 | GUGACUGU CUGAUGU X GAA ACGUUGGG | CCCAACGUC ACAGUCAC |
| 530 | UUUAGGGU CUGAUGU X GAA ACUGUGAC | GUCACAGUC ACCCUAAA |
| 536 | AACUUUUU CUGAUGU X GAA AGGGUGAC | GUCACCCUA AAAAGUU |

Table VIII-continued

Mouse flt-1 VEGF Receptor-Hammerhead Ribozyme and Substrate Sequence

| nt. Position | HH Ribozyme | Substrate |
|---|---|---|
| 544 | CAAAUGGA CUGAUGU X GAA ACUUUUU | AAAAAGUU UCCAUUUG |
| 545 | UCAAAUGG CUGAUGU X GAA AACUUUU | AAAAGUUU CCAUUUGA |
| 546 | AUCAAAUG CUGAUGU X GAA AAACUUU | AAAGUUUC CAUUUGAU |
| 550 | GAGUAUCA CUGAUGU X GAA AUGGAAAC | GUUUCCAUU UGAUACUC |
| 551 | AGAGUAUC CUGAUGU X GAA AAUGGAAA | UUUCCAUUU GAUACUCU |
| 555 | GGUAAGAG CUGAUGU X GAA AUCAAAUG | CAUUUGAUA CUCUUACC |
| 558 | AGGGGUAA CUGAUGU X GAA AGUAUCAA | UUGAUACUC UUACCCCU |
| 560 | UCAGGGGU CUGAUGU X GAA AGAGUAUC | GAUACUCUU ACCCCUGA |
| 561 | AUCAGGGG CUGAUGU X GAA AAGAGUAU | AUACUCUUA CCCCUGAU |
| 581 | UCCCAUGU CUGAUGU X GAA AUUCUUUG | CAAAGAAUA ACAUGGGA |
| 594 | GCCUCUCC CUGAUGU X GAA ACUGUCCC | GGGAGAGUA GGAGAGGC |
| 604 | CUAUUAUA CUGAUGU X GAA AGCCUCUC | GAGAGGCUU UAUAAUAG |
| 605 | GCUAUUAU CUGAUGU X GAA AAGCCUCU | AGAGGCUUU AUAAUAGC |
| 606 | UGCUAUUA CUGAUGU X GAA AAAGCCUC | GAGGCUUUA UAAUAGCA |
| 608 | UUUGCUAU CUGAUGU X GAA AUAAAGCC | GGCUUUAUA AUAGCAAA |
| 611 | GCAUUUGC CUGAUGU X GAA AUUAUAAA | UUUAUAAUA GCAAAUGC |
| 625 | UCUCUUUG CUGAUGU X GAA ACGUUGCA | UGCAACGUA CAAAGAGA |
| 635 | AGCAGUCC CUGAUGU X GAA AUCUCUUU | AAAGAGAUA GGACUGCU |
| 662 | UGCCCGUU CUGAUGU X GAA ACGGUGGC | GCCACCGUC AACGGGCA |
| 676 | UUGUCUGG CUGAUGU X GAA ACAGGUGC | GCACCUGUA CCAGACAA |
| 688 | GGGUCAGA CUGAUGU X GAA AGUUUGUC | CAGAAACUA UCUGACCC |
| 690 | AUGGGUCA CUGAUGU X GAA AUAGUUUG | CAAACUAUC UGACCCAU |
| 699 | GGUCUGCC CUGAUGU X GAA AUGGGUCA | UGACCCAUC GGCAGACC |
| 711 | UAGGAUUG CUGAUGU X GAA AUUGGUCU | AGACCAAUA CAAUCCUA |
| 716 | ACAUCUAG CUGAUGU X GAA AUUGUAUU | AAUACAAUC CUAGAUGU |
| 719 | UGGACAUC CUGAUGU X GAA AGGAUUGU | ACAAUCCUA GAUGUCCA |
| 725 | CGUAUUUG CUGAUGU X GAA ACAUCUAG | CUAGAUGUC CAAAUAGC |
| 731 | GGCGGGCG CUGAUGU X GAA AUUUGGAC | GUCCAAAUA CGCCCGCC |
| 758 | UGCCCGUG CUGAUGU X GAA AGCAGUCU | AGACUGCUC CACGGGCA |
| 771 | GAGGACAA CUGAUGU X GAA AGUCUGCC | GGCAGACUC UUGUCCUC |
| 773 | UUGAGGAC CUGAUGU X GAA AGAGUCUG | CAGACUCUU GUCCUCAA |
| 776 | CAGUUGAG CUGAUGU X GAA ACAAGAGU | ACUCUUGUC CUCAACUG |
| 779 | GUGCAGUU CUGAUGU X GAA AGGACAAG | CUUGUCCUC AACUGCAC |
| 803 | CUCGUAUU CUGAUGU X GAA AGCUCCGU | ACGGAGCUC AAUACGAG |
| 807 | CACCCUCG CUGAUGU X GAA AUUGAGCU | AGCUCAAUA CGAGGGUG |
| 831 | ACCAGGGU CUGAUGU X GAA AUUCCAGC | GCUGGAAUU ACCCUGGU |
| 832 | UACCAGGG CUGAUGU X GAA AAUUCCAG | CUGGAAUUA CCCUGGUA |

Table VIII-continued

Mouse flt-1 VEGF Receptor-Hammerhead Ribozyme and Substrate Sequence

| nt. Position | HH Ribozyme | Substrate |
|---|---|---|
| 840 | AGUUGCUU CUGAUGU X GAA ACCAGGGU | ACCCUGGUA AAGCAACU |
| 849 | UGCUCUCU CUGAUGU X GAA AGUUGCUU | AAGCAACUA AGAGAGCA |
| 859 | GCCUUAUA CUGAUGU X GAA AUGCUCUC | GAGAGCAUC UAUAAGGC |
| 861 | CUGCCUUA CUGAUGU X GAA AGAUGCUC | GAGCAUCUA UAAGGCAG |
| 863 | CGCUGCCU CUGAUGU X GAA AUAGAUGC | GCAUCUAUA AGGCAGCG |
| 875 | CUCCGGUC CUGAUGU X GAA AUCCGCUG | CAGCGGAUU GACCGGAG |
| 888 | GUUGUGGG CUGAUGU X GAA AUGGCUCC | GGAGCCAUU CCCACAAC |
| 889 | UGUUGUGG CUGAUGU X GAA AAUGGCUC | GAGCCAUUC CCACAACA |
| 904 | CACUGUGG CUGAUGU X GAA ACACAUUG | CAAUGUGUU CCACAGUG |
| 905 | ACACUGUG CUGAUGU X GAA AACACAUU | AAUGUGUUC CACAGUGU |
| 914 | AUCUUAAG CUGAUGU X GAA ACACUGUG | CACAGUGUU CUUAAGAU |
| 915 | GAUCUUAA CUGAUGU X GAA AACACUGU | ACAGUGUUC UUAAGAUC |
| 917 | UUGAUCUU CUGAUGU X GAA AGAACACU | AGUGUUCUU AAGAUCAA |
| 918 | GUUGAUCU CUGAUGU X GAA AAGAACAC | GUGUUCUUA AGAUCAAC |
| 923 | ACAUUGUU CUGAUGU X GAA AUCUUAAG | CUUAAGAUC AACAAUGU |
| 953 | CAGGUGUA CUGAUGU X GAA AGCCCCUU | AAGGGGCUC UACACCUG |
| 955 | GACAGGUG CUGAUGU X GAA AGAGCCCC | GGGGCUCUA CACCUGUC |
| 963 | CUUCACGC CUGAUGU X GAA ACAGGUGU | ACACCUGUC GCGUGAAG |
| 979 | GGAACGAG CUGAUGU X GAA ACCCACUC | GAGUGGGUC CUCGUUCC |
| 982 | ACUGGAAC CUGAUGU X GAA AGGACCCA | UGGGUCCUC GUUCCAGU |
| 985 | AAGACUGG CUGAUGU X GAA ACGAGGAC | GUCCUCGUU CCAGUCUU |
| 986 | AAAGACUG CUGAUGU X GAA AACGAGGA | UCCUCGUUC CAGUCUUU |
| 991 | UGUUGAAA CUGAUGU X GAA ACUGGAAC | GUUCCAGUC UUUCAACA |
| 993 | GGUGUUGA CUGAUGU X GAA AGACUGGA | UCCAGUCUU UCAACACC |
| 994 | AGGUGUUG CUGAUGU X GAA AAGACUGG | CCAGUCUUU CAACACCU |
| 995 | GAGGUGUU CUGAUGU X GAA AAAGACUG | CAGUCUUUC AACACCUC |
| 1003 | CAUGCACG CUGAUGU X GAA AGGUGUUG | CAACACCUC CGUGCAUG |
| 1015 | CUUUUUCA CUGAUGU X GAA ACACAUGC | GCAUGUGUA UGAAAAAG |
| 1027 | CACUGAUG CUGAUGU X GAA AUCCUUUU | AAAAGGAUU CAUCAGUG |
| 1028 | ACACUGAU CUGAUGU X GAA AAUCCUUU | AAAGGAUUC AUCAGUGU |
| 1031 | UUCACACU CUGAUGU X GAA AUGAAUCC | GGAUUCAUC AGUGUGAA |
| 1044 | CUGCUUCC CUGAUGU X GAA AUGUUUCA | UGAAACAUC GGAAGCAG |
| 1084 | GCCGAUAG CUGAUGU X GAA ACCGUCUU | AAGACGGUC UAUCGGC |
| 1087 | ACAGCCGA CUGAUGU X GAA AGGACCGU | ACGGUCCUA UCGGCUGU |
| 1089 | GGACAGCC CUGAUGU X GAA AUAGGACC | GGUCCUAUC GGCUGUCC |
| 1096 | CUUUCAUG CUGAUGU X GAA ACAGCCGA | UCGGCUGUC CAUGAAAG |

Table VIII-continued

Mouse flt-1 VEGF Receptor-Hammerhead Ribozyme and Substrate Sequence

| nt. Position | HH Ribozyme | Substrate |
|---|---|---|
| 1114 | GGGAGGGG CUGAUGU X GAA AGGCCUUC | GAAGGCCUU CCCCUCCC |
| 1115 | GGGGAGGG CUGAUGU X GAA AAGGCCUU | AAGGCCUUC CCCUCCCC |
| 1120 | UUUCUGGG CUGAUGU X GAA AGGGGAAG | CUUCCCCUC CCCAGAAA |
| 1130 | AACCAUAC CUGAUGU X GAA AUUUCUGG | CCAGAAAUC GUAUGGUU |
| 1133 | UUUAACCA CUGAUGU X GAA ACGAUUUC | GAAAUCGUA UGGUUAAA |
| 1138 | CAUCUUUU CUGAUGU X GAA ACCAUACG | CGUAUGGUU AAAAGAUG |
| 1139 | CCAUCUUU CUGAUGU X GAA AACCAUAC | GUAUGGUUA AAAGAUGG |
| 1150 | UUGCAGGC CUGAUGU X GAA AGCCAUCU | AGAUGGCUC GCCUGCAA |
| 1162 | CAGACUUC CUGAUGU X GAA AUGUUGCA | UGCAACAUU GAAGUCUG |
| 1168 | AGCGAGCA CUGAUGU X GAA ACUUCAAU | AUUGAAGUC UGCUCGCU |
| 1173 | CAAAUAGC CUGAUGU X GAA AGCAGACU | AGUCUGCUC GCUAUUUG |
| 1177 | GUACCAAA CUGAUGU X GAA AGCGAGCA | UGCUCGCUA UUUGGUAC |
| 1179 | AUGUACCA CUGAUGU X GAA AUAGCGAG | CUCGCUAUU UGGUACAU |
| 1180 | CAUGUACC CUGAUGU X GAA AAUAGCGA | UCGCUAUUU GGUACAUG |
| 1184 | UAGCCAUG CUGAUGU X GAA ACCAAAUC | UAUUUGGUA CAUGGCUA |
| 1192 | UUAAUGAG CUGAUGU X GAA AGCCAUGU | ACAUGGCUA CUCAUUAA |
| 1195 | UAAUUAAU CUGAUGU X GAA AGUAGCCA | UGGCUACUC AUUAAUUA |
| 1198 | UGAUAAUU CUGAUGU X GAA AUGAGUAG | CUACUCAUU AAUUAUCA |
| 1199 | UUGAUAAU CUGAUGU X GAA AAUGAGUA | UACUCAUUA AUUAUCAA |
| 1202 | UCUUUGAU CUGAUGU X GAA AUUAAUGA | UCAUUAAUU AUCAAAGA |
| 1203 | AUCUUUGA CUGAUGU X GAA AAUUAAUG | CAUUAAUUA UCAAAGAU |
| 1205 | ACAUCUUU CUGAUGU X GAA AUAAUUAA | UUAAUUAUC AAAGAUGU |
| 1237 | AGAUCGUA CUGAUGU X GAA AGUCCCCU | AGGGGACUA UACGAUCU |
| 1239 | CAAGAUCG CUGAUGU X GAA AUAGUCCC | GGGACUAUA CGAUCUUG |
| 1244 | CCCAGCAA CUGAUGU X GAA AUCGUAUA | UAUACGAUC UUGCUGGG |
| 1246 | UGCCCAGC CUGAUGU X GAA AGAUCGUA | UACGAUCUU GCUGGGCA |
| 1256 | GACUGCUU CUGAUGU X GAA AUGCCCAG | CUGGGCAUA AAGCAGUC |
| 1264 | AUAGCCUU CUGAUGU X GAA ACUGCUUU | AAAGCAGUC AAGGCUAU |
| 1271 | UUUUUAAA CUGAUGU X GAA AGCCUUGA | UCAAGGCUA UUUAAAAA |
| 1273 | GGUUUUUA CUGAUGU X GAA AUAGCCUU | AAGGCUAUU UAAAAACC |
| 1274 | AGGUUUUU CUGAUGU X GAA AAUAGCCU | AGGCUAUUU AAAAACCU |
| 1275 | GAGGUUUU CUGAUGU X GAA AAAUAGCC | GGCUAUUUA AAAACCUC |
| 1283 | GUGGCAGU CUGAUGU X GAA AGGUUUUU | AAAAACCUC ACUGCCAC |
| 1293 | UACAAUGA CUGAUGU X GAA AGUGGCAG | CUGCCACUC UCAUUGUA |
| 1295 | UUUACAAU CUGAUGU X GAA AGAGUGGC | GCCACUCUC AUUGUAAA |
| 1298 | ACGUUUAC CUGAUGU X GAA AUGAGAGU | ACUCUCAUU GUAAACGU |
| 1301 | UUCACGUU CUGAUGU X GAA ACAAUGAG | CUCAUUGUA AACGUGAA |

Table VIII-continued

Mouse flt-1 VEGF Receptor-Hammerhead Ribozyme and Substrate Sequence

| nt. Position | HH Ribozyme | Substrate |
|---|---|---|
| 1314 | GUAGAUCU CUGAUGU X GAA AGGUUUCA | UGAAACCUC AGAUCUAC |
| 1319 | UUUUCGUA CUGAUGU X GAA AUCUGAGG | CCUCAGAUC UACGAAAA |
| 1321 | ACUUUUCG CUGAUGU X GAA AGAUCUGA | UCAGAUCUA CGAAAAGU |
| 1330 | AGGACACG CUGAUGU X GAA ACUUUUCG | CGAAAAGUC CGUGUCCU |
| 1336 | GAAGCGAG CUGAUGU X GAA ACACGGAC | GUCCGUGUC CUCGCUUC |
| 1339 | UUGGAAGC CUGAUGU X GAA AGGACACG | CGUGUCCUC GCUUCCAA |
| 1343 | GGGCUUGG CUGAUGU X GAA AGCGAGGA | UCCUCGCUU CCAAGCCC |
| 1344 | UGGGCUUG CUGAUGU X GAA AAGCGAGG | CCUCGCUUC CAAGCCCA |
| 1356 | CGGAUAGA CUGAUGU X GAA AGGUGGGC | GCCCACCUC UCUAUCCG |
| 1358 | AGCGGAUA CUGAUGU X GAA AGAGGUGG | CCACCUCUC UAUCCGCU |
| 1360 | CCAGCGGA CUGAUGU X GAA AGAGAGGU | ACCUCUCUA UCCGCUGG |
| 1362 | GCCCAGCG CUGAUGU X GAA AUAGAGAG | CUCUCUAUC CGCUGGGC |
| 1382 | CAAGUGAG CUGAUGU X GAA ACUUGUCU | AGACAAGUC CUCACUUG |
| 1385 | GUGCAAGU CUGAUGU X GAA AGGACUUG | CAAGUCCUC ACUUGCAC |
| 1389 | CACGGUGC CUGAUGU X GAA AGUGAGGA | UCCUCACUU GCACCGUG |
| 1399 | GGAUGCCA CUGAUGU X GAA ACACGGUG | CACCGUGUA UGGCAUCC |
| 1406 | GGCCGAGG CUGAUGU X GAA AUGCCAUA | UAUGGCAUC CCUCGGCC |
| 1410 | UGUUGGCC CUGAUGU X GAA AGGGAUGC | GCAUCCCUC GGCCAACA |
| 1421 | AGCCACGU CUGAUGU X GAA AUUGUUGG | CCAACAAUC ACGUGGCU |
| 1430 | GGGUGCCA CUGAUGU X GAA AGCCACGU | ACGUGGCUC UGGCACCC |
| 1443 | AUUGUGGU CUGAUGU X GAA ACAGGGGU | ACCCCUGUC ACCACAAU |
| 1452 | UUUGGAGU CUGAUGU X GAA AUUGUGGU | ACCACAAUC ACUCCAAA |
| 1456 | UUUCUUUG CUGAUGU X GAA AGUGAUUG | CAAUCACUC CAAAGAAA |
| 1468 | AGAAGUCA CUGAUGU X GAA ACCUUUCU | AGAAAGGUA UGACUUCU |
| 1474 | CAGUGCAG CUGAUGU X GAA AGUCAUAC | GUAUGACUU CUGCACUG |
| 1475 | UCAGUGCA CUGAUGU X GAA AAGUCAUA | UAUGACUUC UGCACUGA |
| 1495 | GGAUAAAG CUGAUGU X GAA AUUCUUCA | UGAAGAAUC CUUUAUCC |
| 1498 | CCAGGAUA CUGAUGU X GAA AGGAUUCU | AGAAUCCUU UAUCCUGG |
| 1499 | UCCAGGAU CUGAUGU X GAA AAGGAUUC | GAAUCCUUU AUCCUGGA |
| 1500 | AUCCAGGA CUGAUGU X GAA AAAGGAUU | AAUCCUUUA UCCUGGAU |
| 1502 | GGAUCCAG CUGAUGU X GAA AUAAAGGA | UCCUUUAUC CUGGAUCC |
| 1509 | GCUGCUGG CUGAUGU X GAA AUCCAGGA | UCCUGGAUC CCAGCAGC |
| 1522 | UGUUUCCU CUGAUGU X GAA AGUUGCUG | CAGCAAGUU AGGAAACA |
| 1523 | CUGUUUCC CUGAUGU X GAA AAGUUGCU | AGCAACUUA GGAAACAG |
| 1535 | AUGCUCUC CUGAUGU X GAA AUUCUGUU | AACAGAAUU GAGAGCAU |
| 1544 | CGCUGAGA CUGAUGU X GAA AUGCUCUC | GAGAGCAUC UCUCAGCG |

Table VIII-continued

Mouse flt-1 VEGF Receptor-Hammerhead Ribozyme and Substrate Sequence

| nt. Position | HH Ribozyme | Substrate |
|---|---|---|
| 1546 | UGCGCUGA CUGAUGU X GAA AGAUGCUC | AGACAUCUC UCAGCGCA |
| 1548 | CAUGCGCU CUGAUGU X GAA AGAGAUGC | GCAUCUCUC AGCGCAUG |
| 1562 | CCUUCUAU CUGAUGU X GAA ACCGUCAU | AUGACGGUC AUAGAAGG |
| 1565 | GUUCCUUC CUGAUGU X GAA AUGACCGU | ACGGUCAUA GAAGGAAC |
| 1578 | AACCGUCU CUGAUGU X GAA AUUUGUUC | GAACAAAUA AGACGGUU |
| 1586 | AAUGUGCU CUGAUGU X GAA ACCGUCUU | AAGACGGUU AGCACAUU |
| 1587 | CAAUGUGC CUGAUGU X GAA AACCGUCU | AGACGGUUA GCACAUUG |
| 1594 | CCACCACC CUGAUGU X GAA AUGUGCUA | UAGCACAUU GGUGGUGG |
| 1609 | GGGUCUGA CUGAUGU X GAA AGUCAGCC | GGCUGACUC UCAGACCC |
| 1611 | AGGGGUCU CUGAUGU X GAA AGAGUCAG | CUGACUCUC AGACCCCU |
| 1625 | CAGCUGUA CUGAUGU X GAA AUUCCAGG | CCUGGAAUC UACAGCUG |
| 1627 | GGCAGCUG CUGAUGU X GAA AGAUUCCA | UGGAAUCUA CAGCUGCC |
| 1642 | UUUUAUUG CUGAUGU X GAA AGGCCCGG | CCGGGCCUU CAAUAAAA |
| 1643 | AUUUUAUU CUGAUGU X GAA AAGGCCCG | CGGGCCUUC AAUAAAAU |
| 1647 | CCCUAUUU CUGAUGU X GAA AUUGAAGG | CCUUCAAUA AAAUAGGG |
| 1652 | ACAGUCCC CUGAUGU X GAA AUUUUAUU | AAUAAAAUA GGGACUGU |
| 1673 | UAAAAUUU CUGAUGU X GAA AUGUUUCU | AGAAACAUA AAAUUUUA |
| 1678 | UGACAUAA CUGAUGU X GAA AUUUUAUG | CAUAAAAUU UUAUGUCA |
| 1679 | GUGACAUA CUGAUGU X GAA AAUUUUAU | AUAAAAUUU UAUGUCAC |
| 1680 | UGUGACAU CUGAUGU X GAA AAAUUUUA | UAAAAUUUU AUGUCACA |
| 1681 | CUGUGACA CUGAUGU X GAA AAAAUUUU | AAAAUUUUA UGUCACAG |
| 1685 | ACAUCUGU CUGAUGU X GAA ACAUAAAA | UUUUAUGUC ACAGAUGU |
| 1705 | AAACGUGA CUGAUGU X GAA AGCCAUUC | GAAUGGCUU UCACGUUU |
| 1706 | GAAACGUG CUGAUGU X GAA AAGCCAUU | AAUGGCUUU CACGUUUC |
| 1707 | GGAAACGU CUGAUGU X GAA AAAGCCAU | AUGGCUUUC ACGUUUCC |
| 1712 | UCCAAGGA CUGAUGU X GAA ACGUGAAA | UUUCACGUU UCCUUGGA |
| 1713 | UUCCAAGG CUGAUGU X GAA AACGUGAA | UUCACGUUU CCUUGGAA |
| 1714 | UUUCCAAG CUGAUGU X GAA AAACGUGA | UCACGUUUC CUUGGAAA |
| 1717 | UCUUUCC CUGAUGU X GAA AGGAAACG | CGUUUCCUU GGAAAAGA |
| 1756 | CCACACAG CUGAUGU X GAA ACAGUUUC | GAAACUGUC CUGUGUGG |
| 1766 | AAUUUAUU CUGAUGU X GAA ACCACACA | UGUGUGGUC AAUAAAUU |
| 1770 | CAGGAAUU CUGAUGU X GAA AUUGACCA | UGGUCAAUA AAUUCCUG |
| 1774 | UGUACAGG CUGAUGU X GAA AUUUAUUG | CAAUAAAUU CCUGUACA |
| 1775 | CUGUACAG CUGAUGU X GAA AAUUUAUU | AAUAAAUUC CUGUACAG |
| 1780 | UGUCUCUG CUGAUGU X GAA ACAGGAAU | AUUCCUGUA CAGAGACA |
| 1790 | AUCCAGGU CUGAUGU X GAA AUGUCUCU | AGAGACAUU ACCUGGAU |
| 1791 | AAUCCAGG CUGAUGU X GAA AAUGUCUC | GAGACAUUA CCUGGAUU |

Table VIII-continued

Mouse flt-1 VEGF Receptor-Hammerhead Ribozyme and Substrate Sequence

| nt. Position | HH Ribozyme | Substrate |
|---|---|---|
| 1799 | GGUAGCAG CUGAUGU X GAA AUCCAGGU | ACCUGGAUU CUGCUACG |
| 1800 | CCGUAGCA CUGAUGU X GAA AAUCCAGG | CCUGGAUUC UGCUACGG |
| 1805 | ACUGUCCG CUGAUGU X GAA AGCAGAAU | AUUCUGCUA CGGACAGU |
| 1814 | CUGUUGUU CUGAUGU X GAA ACUGUCCG | CGGACAGUU AACAACAG |
| 1815 | UCUGUUGU CUGAUGU X GAA AACUGUCC | GGACAGUUA ACAACAGA |
| 1836 | GCUGAUAC CUGAUGU X GAA AUGGUGCA | UGCACCAUA GUAUCAGC |
| 1839 | CUUGCUGA CUGAUGU X GAA ACUAUGGU | ACCAUAGUA UCAGCAAG |
| 1841 | UGCUUGCU CUGAUGU X GAA AUACUAUG | CAUAGUAUC AGCAAGCA |
| 1866 | GUAAUCUU CUGAUGU X GAA AGUGGUGG | CCACCACUC AAGAUUAC |
| 1872 | GAUGGAGU CUGAUGU X GAA AUCUUGAG | CUCAAGAUU ACUCCAUC |
| 1873 | UGAUGGAG CUGAUGU X GAA AAUCUUGA | UCAAGAUUA CUCCAUCA |
| 1876 | GAGUGAUG CUGAUGU X GAA AGUAAUCU | AGAUUACUC CAUCACUC |
| 1880 | UUCAGAGU CUGAUGU X GAA AUGGAGUA | UACUCCAUC ACUCUGAA |
| 1884 | AAGGUUCA CUGAUGU X GAA AGUGAUGG | CCAUCACUC UGAACCUU |
| 1892 | UUGAUGAC CUGAUGU X GAA AGGUUCAG | CUGAACCUU GUCAUCAA |
| 1895 | UUCUUGAU CUGAUGU X GAA ACAAGGUU | AACCUUGUC AUCAAGAA |
| 1898 | ACGUUCUU CUGAUGU X GAA AUGACAAG | CUUGUCAUC AAGAACGU |
| 1909 | CUUCUAGA CUGAUGU X GAA ACACGUUC | GAACGUGUC UCUAGAAG |
| 1911 | GUCUUCUA CUGAUGU X GAA AGACACGU | ACGUGUCUC UAGAAGAC |
| 1913 | GAGUCUUC CUGAUGU X GAA AGAGACAC | GUGUCUCUA GAAGACUC |
| 1921 | AGGUGCCC CUGAUGU X GAA AGUCUUCU | AGAACACUC GGGCACCU |
| 1930 | UGCACGCA CUGAUGU X GAA AGGUGCCC | GGGCACCUA UGCGUGCA |
| 1952 | CCUGUGUA CUGAUGU X GAA AUGUUCCU | AGGAACAUA UACACAGG |
| 1954 | CCCCUGUG CUGAUGU X GAA AUAUGUUC | GAACAUAUA CACAGGGG |
| 1970 | UUCCGAAG CUGAUGU X GAA AUGUCUUC | GAAGACAUC UUCGGAA |
| 1973 | GUCUUCCG CUGAUGU X GAA AGGAUGUC | GACAUCCUU CGGAAGAC |
| 1974 | UGUCUUCC CUGAUGU X GAA AAGGAUGU | ACAUCCUUC GGAAGACA |
| 1988 | CUAACGAG CUGAUGU X GAA ACUUCUGU | ACAGAAGUU CUCGUUAG |
| 1989 | UCUAACGA CUGAUGU X GAA AACUUCUG | CAGAAGUUC UCGUUAGA |
| 1991 | UCUCUAAC CUGAUGU X GAA AGAACUUC | GAAGUUCUC GUUAGAGA |
| 1994 | GAAUCUCU CUGAUGU X GAA ACGAGAAC | GUUCUCGUU AGAGAUUC |
| 1995 | CGAAUCUC CUGAUGU X GAA AACGAGAA | UUCUCGUUA GAGAUUCG |
| 2001 | CGCUUCCG CUGAUGU X GAA AUCUCUAA | UUAGAGAUU CGGAAGCG |
| 2002 | GCGCUUCC CUGAUGU X GAA AAUCUCUA | UAGAGAUUC GGAAGCGC |
| 2021 | AGGUUUUG CUGAUGU X GAA AGCAGGUG | CACCUGCUU CAAAACCU |
| 2022 | GAGGUUUU CUGAUGU X GAA AAGCAGGU | ACCUGCUUC AAAACCUC |

Table VIII-continued

Mouse flt-1 VEGF Receptor-Hammerhead Ribozyme and Substrate Sequence

| nt. Position | HH Ribozyme | Substrate |
|---|---|---|
| 2030 | UAGUCACU CUGAUGU X GAA AGGUUUUG | CAAAACCUC AGUGACUA |
| 2038 | AGACCUCG CUGAUGU X GAA AGUCACUG | CAGUGACUA CGAGGUCU |
| 2045 | CUGAUGGA CUGAUGU X GAA ACCUCGUA | UACGAGGUC UCCAUCAG |
| 2047 | CACUGAUG CUGAUGU X GAA AGACCUCG | CGAGGUCUC CAUCAGUG |
| 2051 | GAGCCACU CUGAUGU X GAA AUGGAGAC | GUCUCCAUC AGUGGCUC |
| 2059 | AGGUCGUA CUGAUGU X GAA AGCCACUG | CAGUGGCUC UACGACCU |
| 2061 | UAAGGUCG CUGAUGU X GAA AGAGCCAC | GUGGCUCUA CGACCUUA |
| 2068 | GACAGUCU CUGAUGU X GAA AGGUCGUA | UACGACCUU AGACUGUC |
| 2069 | UGACAGUC CUGAUGU X GAA AAGGUCGU | ACGACCUUA GACUGUCA |
| 2076 | UCUAGCUU CUGAUGU X GAA ACAGUCUA | UAGACUGUC AAGCUAGA |
| 2082 | GACACCUC CUGAUGU X GAA AGCUUGAC | GUCAAGCUA GAGGUGUC |
| 2090 | GGCGCGGG CUGAUGU X GAA ACACCUGU | AGAGGUGUC CCCGCGCC |
| 2100 | AGUGAUCU CUGAUGU X GAA AGGCGCGG | CCGCGCCUC AGAUCACU |
| 2105 | AACCAAGU CUGAUGU X GAA AUCUGAGG | CCUCAGAUC ACUUGGUU |
| 2109 | UUUGAACC CUGAUGU X GAA AGUGAUCU | AGAUCACUU GGUUCAAA |
| 2113 | UGUUUUG CUGAUGU X GAA ACCAAGUG | CACUUGGUU CAAAAACA |
| 2114 | UUGUUUUU CUGAUGU X GAA AACCAAGU | ACUUGGUUC AAAAACAA |
| 2132 | UCUUGUUG CUGAUGU X GAA AUUUUGUG | CACAAAAUA CAACAAGA |
| 2150 | CCUAAAAU CUGAUGU X GAA AUUCCCGG | CCGGGAAUU AUUUUAGG |
| 2151 | UCCUAAAA CUGAUGU X GAA AAUUCCCG | CGGGAAUUA UUUUAGGA |
| 2153 | GGUCCUAA CUGAUGU X GAA AUAAUUCC | GGAAUUAUU UUAGGACC |
| 2154 | UGGUCCUA CUGAUGU X GAA AAUAAUUC | GAAUUAUUU UAGGACCA |
| 2155 | CUGGUCCU CUGAUGU X GAA AAAUAAUU | AAUUAUUUU AGGACCAG |
| 2156 | CCUGGUCC CUGAUGU X GAA AAAAUAAU | AUUAUUUUA GGACCAGG |
| 2179 | UUUCAAUA CUGAUGU X GAA ACAGCGUG | CACGCUGUU UAUUGAAA |
| 2180 | CUUUCAAU CUGAUGU X GAA AACAGCGU | ACGCUGUUU AUUGAAAG |
| 2181 | UCUUUCAA CUGAUGU X GAA AAACAGCG | CGCUGUUUA UUGAAAGA |
| 2183 | ACUCUUUC CUGAUGU X GAA AUAAACAG | CUGUUUAUU GAAAGAGU |
| 2192 | UCCUCUGU CUGAUGU X GAA ACUCUUUC | GAAAGAGUC ACAGAGGA |
| 2213 | CACCUAUA CUGAUGU X GAA ACACCCUC | GAGGGUGUC UAUAGGUG |
| 2215 | GGCACCUA CUGAUGU X GAA AGACACCC | GGGUGUCUA UAGGUGCC |
| 2217 | UCGGCACC CUGAUGU X GAA AUAGACAC | GUGUCUAUA GGUGCCGA |
| 2263 | CGGUGAGG CUGAUGU X GAA AGGCUGCG | CGCAGCCUA CCUCACCG |
| 2267 | UGCACGGU CUGAUGU X GAA AGGUAGGC | GCCUACCUC ACCGUGCA |
| 2284 | ACUUGUCU CUGAUGU X GAA AGGUUCCU | AGGAACCUC AGACAAGU |
| 2293 | CCAGGUUU CUGAUGU X GAA ACUUGUCU | AGACAAGUC AAACCUGG |
| 2309 | GUGAGCGU CUGAUGU X GAA AUCAGCUC | GAGCUGAUC ACGCUCAC |

Table VIII-continued

Mouse flt-1 VEGF Receptor-Hammerhead Ribozyme and Substrate Sequence

| nt. Position | HH Ribozyme | Substrate |
|---|---|---|
| 2315 | GUGCACGU CUGAUGU X GAA AGCGUGAU | AUCACGCUC ACGUGCAC |
| 2342 | AGCCAAAA CUGAUGU X GAA AGGGUCGC | GCGACCCUC UUUUGGCU |
| 2344 | GGAGCCAA CUGAUGU X GAA AGAGGGUC | GACCCUCUU UUGGCUCC |
| 2345 | AGGAGCCA CUGAUGU X GAA AAGAGGGU | ACCCUCUUU UGGCUCCU |
| 2346 | AAGGAGCC CUGAUGU X GAA AAAGAGGG | CCCUCUUUU GGCUCCUU |
| 2351 | GUUAGAAG CUGAUGU X GAA AGCCAAAA | UUUUGGCUC CUUCUAAC |
| 2354 | AGAGUUAG CUGAUGU X GAA AGGAGCCA | UGGCUCCUU CUAACUCU |
| 2355 | GAGAGUUA CUGAUGU X GAA AAGGAGCC | GGCUCCUUC UAACUCUC |
| 2357 | AAGAGAGU CUGAUGU X GAA AGAAGGAG | CUCCUUCUA ACUCUCUU |
| 2361 | GAUGAAGA CUGAUGU X GAA AGUUAGAA | UUCUAACUC UCUUCAUC |
| 2363 | CUGAUGAA CUGAUGU X GAA AGAGUUAG | CUAACUCUC UUCAUCAG |
| 2365 | UUCUGAUG CUGAUGU X GAA AGAGAGUU | AACUCUCUU CAUCAGAA |
| 2366 | UUUCUGAU CUGAUGU X GAA AAGAGAGU | ACUCUCUUC AUCAGAAA |
| 2369 | AGUUUCU CUGAUGU X GAA AUGAAGAG | CUCUUCAUC AGAAAACU |
| 2386 | CGGAAGAA CUGAUGU X GAA ACCGCUUC | GAAGCGGUC UUCUUCCG |
| 2388 | UUCGGAAG CUGAUGU X GAA AGACCGCU | AGCGGUCUU CUUCCGAA |
| 2389 | CUUCGGAA CUGAUGU X GAA AAGACCGC | GCGGUCUUC UUCCGAAG |
| 2391 | UACUUCGG CUGAUGU X GAA AGAAGACC | GGUCUUCUU CCGAAGUA |
| 2392 | UUACUUCG CUGAUGU X GAA AAGAAGAC | GUCUUCUUC CGAAGUAA |
| 2399 | UCUGUCUU CUGAUGU X GAA ACUUCGGA | UCCGAAGUA AAGACAGA |
| 2410 | UUGACAGG CUGAUGU X GAA AGUCUGUC | GACAGACUA CCUGUCAA |
| 2416 | UAAUGAUU CUGAUGU X GAA ACAGGUAG | CUACCUGUC AAUCAUUA |
| 2420 | UCCAUAAU CUGAUGU X GAA AUUGACAG | CUGUCAAUC AUUAUGGA |
| 2423 | GGGUCCAU CUGAUGU X GAA AUGAUUGA | UCAAUCAUU AUGGACCC |
| 2424 | UGGGUCCA CUGAUGU X GAA AAUGAUUG | CAAUCAUUA UGGACCCA |
| 2441 | UCCAGGGG CUGAUGU X GAA ACUUCAUC | GAUGAAGUU CCCCUGGA |
| 2442 | AUCCAGGG CUGAUGU X GAA AACUUCAU | AUGAAGUUC CCCUGGAU |
| 2473 | UGGCAUCA CUGAUGU X GAA AGGGCAGC | GCUGCCCUA UGAUGCCA |
| 2494 | CCCGUGCA CUGAUGU X GAA ACUCCCAC | GUGGGAGUU UGCACGGG |
| 2495 | UCCCGUGC CUGAUGU X GAA AACUCCCA | UGGGAGUUU GCACGGGA |
| 2516 | GAUUGCC CUGAUGU X GAA AGUUUCAG | CUGAAACUA GGCAAAUC |
| 2524 | UUCCGAGC CUGAUGU X GAA AUUUGCCU | AGGCAAAUC GCUCGGAA |
| 2528 | CCUCUUCC CUGAUGU X GAA AGCGAUUU | AAAUCGCUC GGAAGAGG |
| 2541 | UUUCCCAA CUGAUGU X GAA AGCCCCUC | GAGGGGCUU UUGGGAAA |
| 2542 | CUUUCCCA CUGAUGU X GAA AAGCCCCU | AGGGGCUUU UGGGAAAG |
| 2543 | ACUUUCCC CUGAUGU X GAA AAAGCCCC | GGGGCUUUU GGGAAAGU |

Table VIII-continued

Mouse flt-1 VEGF Receptor-Hammerhead Ribozyme and Substrate Sequence

| nt. Position | HH Ribozyme | Substrate |
|---|---|---|
| 2552 | GCUUGAAC CUGAUGU X GAA ACUUCCC | GGGAAAGUC GUUCAAGC |
| 2555 | GAGGCUUG CUGAUGU X GAA ACGACUUU | AAAGUCGUU CAAGCCUC |
| 2556 | AGAGGCUU CUGAUGU X GAA AACGACUU | AAGUCGUUC AAGCCUCU |
| 2563 | CAAAUGCA CUGAUGU X GAA AGGCUUGA | UCAAGCCUC UGCAUUUG |
| 2569 | UAAUGCCA CUGAUGU X GAA AUGCAGAG | CUCUGCAUU UGGCAUUA |
| 2570 | UUAAUGCC CUGAUGU X GAA AAUGCAGA | UCUGCAUUU GGCAUUAA |
| 2576 | GAUUUCUU CUGAUGU X GAA AUGCCAAA | UUUGGCAUU AAGAAAUC |
| 2577 | UGAUUUCU CUGAUGU X GAA AAUGCCAA | UUGGCAUUA AGAAAUCA |
| 2584 | AGGUGGGU CUGAUGU X GAA AUUUCUUA | UAAGAAAUC ACCCACCU |
| 2617 | CCUCUUUC CUGAUGU X GAA ACAUCUUC | GAAGAUGUU GAAAGAGG |
| 2644 | GAGCUUUG CUGAUGU X GAA ACUCACUG | CAGUGAGUA CAAAGCUC |
| 2652 | GGUCAUCA CUGAUGU X GAA AGCUUUGU | ACAAAGCUC UGAUGACC |
| 2666 | AAGAUCUU CUGAUGU X GAA AGUUCGGU | ACCGAACUC AAGAUCUU |
| 2672 | UGGGUCAA CUGAUGU X GAA AUCUUGAG | CUCAAGAUC UUGACCCA |
| 2674 | UGUGGGUC CUGAUGU X GAA AGAUCUUG | CAAGAUCUU GACCCACA |
| 2684 | UGAUGGCC CUGAUGU X GAA AUGUGGGU | ACCCACAUC GGCCAUCA |
| 2691 | AUUCAGAU CUGAUGU X GAA AUGGCCGA | AUGGCCAUC AUCUGAAU |
| 2694 | CACAUUCA CUGAUGU X GAA AUGAUGGC | GCCAUCAUC UGAAUGUG |
| 2705 | AGGAGGUU CUGAUGU X GAA ACCACAUU | AAUGUGGUU AACCUCCU |
| 2706 | CAGGAGGU CUGAUGU X GAA AACCACAU | AUGUGGUUA ACCUCCUG |
| 2711 | GCUCCCAG CUGAUGU X GAA AGGUUAAC | GUUAACCUC CUGGGAGC |
| 2742 | CACCAUCA CUGAUGU X GAA AGGCCCUC | GAGGGCCUC UGAUGGUG |
| 2753 | UAUCCAC CUGAUGU X GAA AUCACCAU | AUGGUGAUC GUGGAAUA |
| 2761 | AUUUGCAG CUGAUGU X GAA AUUCCACG | CGUGGAAUA CUGCAAAU |
| 2770 | GGUUUCCG CUGAUGU X GAA AUUUGCAG | CUGCAAAUA AGGAAACC |
| 2782 | GGUAGUUG CUGAUGU X GAA ACAGGUUU | AAACCUGUC CAACUACC |
| 2788 | UCUUGAGG CUGAUGU X GAA AGUUGGAC | GUCCAACUA CCUCAAGA |
| 2792 | UUGCUCUU CUGAUGU X GAA AGGUAGUU | AACUACCUC AAGAGCAA |
| 2809 | GACAGAAU CUGAUGU X GAA AGUCACGU | ACGUGACUU AUUCUGUC |
| 2810 | AGACAGAA CUGAUGU X GAA AAGUCACG | CGUGACUUA UUCUGUCU |
| 2812 | UGACACAG CUGAUGU X GAA AUAAGUCA | UGACUUAUU CUGUCUCA |
| 2813 | UUGAGACA CUGAUGU X GAA AAUAAGUC | GACUUAUUC UGUCUCAA |
| 2817 | CUUGUUGA CUGAUGU X GAA ACAGAAUA | UAUUCUGUC UCAACAAG |
| 2819 | UCCUUGUU CUGAUGU X GAA AGACAGAA | UUCUGUCUC AACAAGGA |
| 2836 | CCAUAUGC CUGAUGU X GAA AGGCUGCG | CGCAGCCUU GCAUAUGG |
| 2841 | GAGCUCCA CUGAUGU X GAA AUGCAAGG | CCUUGCAUA UGGAGCUC |
| 2849 | UCUUUCUU CUGAUGU X GAA AGCUCCAU | AUGGAGCUC AAGAAAGA |

Table VIII-continued

Mouse flt-1 VEGF Receptor-Hammerhead Ribozyme and Substrate Sequence

| nt. Position | HH Ribozyme | Substrate |
|---|---|---|
| 2900 | ACACUGUC CUGAUGU X GAA AGGCGGGG | CCCCGCCUA GACAGUGU |
| 2909 | GAGCUGCU CUGAUGU X GAA ACACUGUC | GACAGUGUC AGCAGCUC |
| 2917 | UGACACUU CUGAUGU X GAA AGCUGCUC | CAGCAGCUC AAGUGUCA |
| 2924 | GAGCUGGU CUGAUGU X GAA ACACUUGA | UCAAGUGUC ACCAGCUC |
| 2932 | GGAAGCUG CUGAUGU X GAA AGCUGGUG | CACCAGCUC CAGCUUCC |
| 2938 | CUUCAGGG CUGAUGU X GAA AGCUGGAG | CUCCAGCUU CCCUGAAG |
| 2939 | UCUUCAGG CUGAUGU X GAA AAGCUGGA | UCCAGCUUC CCUGAAGA |
| 2982 | CUCACUGU CUGAUGU X GAA AUCCUCGU | ACGAGGAUU ACAGUGAG |
| 2983 | UCUCACUG CUGAUGU X GAA AAUCCUCG | CGAGGAUUA CAGUGAGA |
| 2993 | UGCUUGGA CUGAUGU X GAA AUCUCACU | AGUGAGAUC UCCAAGCA |
| 2995 | GCUGCUUG CUGAUGU X GAA AGAUCUCA | UGAGAUCUC CAAGCAGC |
| 3008 | UCCAUGGU CUGAUGU X GAA AGGGGCUG | CAGCCCCUC ACCAUGGA |
| 3026 | CUGUAGGA CUGAUGU X GAA AUCAGGUC | GACCUGAUU UCCUACAG |
| 3027 | ACUGUAGG CUGAUGU X GAA AAUCAGGU | ACCUGAUUU CCUACAGU |
| 3028 | AACUGUAG CUGAUGU X GAA AAAUCAGG | CCUGAUUUC CUACAGUU |
| 3031 | GGAAACUG CUGAUGU X GAA AGGAAAUC | GAUUUCCUA CAGUUUCC |
| 3036 | CACUUGGA CUGAUGU X GAA ACUGUAGG | CCUACAGUU UCCAAGUG |
| 3037 | CCACUUGG CUGAUGU X GAA AACUGUAG | CUACAGUUU CCAAGUGG |
| 3038 | GCCACUUG CUGAUGU X GAA AAACUGUA | UACAGUUUC CAAGUGGC |
| 3061 | AGGACAGA CUGAUGU X GAA ACUCCAUG | CAUGGAGUU UCUGUCCU |
| 3062 | GAGGACAG CUGAUGU X GAA AACUCCAU | AUGGAGUUU CUGUCCUC |
| 3063 | GGAGGACA CUGAUGU X GAA AAACUCCA | UGGAGUUUC UGUCCUCC |
| 3067 | UUCUGGAG CUGAUGU X GAA ACAGAAAC | GUUUCUGUC CUCCAGAA |
| 3070 | ACUUUCUG CUGAUGU X GAA AGGACAGA | UCUGUCCUC CAGAAAGU |
| 3083 | UCCCGAUG CUGAUGU X GAA AUGCACUU | AAGUGCAUU CAUCGGGA |
| 3084 | GUCCCGAU CUGAUGU X GAA AAUGCACU | AGUGCAUUC AUCGGGAC |
| 3087 | CAGGUCCC CUGAUGU X GAA AUGAAUGC | GCAUUCAUC GGGACCUG |
| 3110 | GAUAAAAG CUGAUGU X GAA AUGUUUCU | AGAAACAUC CUUUUAUC |
| 3113 | UCAGAUAA CUGAUGU X GAA AGGAUGUU | AACAUCCUU UUAUCUGA |
| 3114 | CUCAGAUA CUGAUGU X GAA AAGGAUGU | ACAUCCUUU UAUCUGAG |
| 3115 | UCUCAGAU CUGAUGU X GAA AAAGGAUG | CAUCCUUUU AUCUGAGA |
| 3116 | UUCUCAGA CUGAUGU X GAA AAAAGGAU | AUCCUUUUA UCUGAGAA |
| 3118 | UGUUCUCA CUGAUGU X GAA AUAAAAGG | CCUUUUAUC UGAGAACA |
| 3140 | AAGUCGCA CUGAUGU X GAA AUCUUCAC | GUGAAGAUU AGCGACUU |
| 3141 | AAAGUCGC CUGAUGU X GAA AAUCUUCA | UGAAGAUUU GCGACUUU |
| 3148 | CCAGGCCA CUGAUGU X GAA AGUCGCAA | UUGCGACUU AGGCCUGG |

Table VIII-continued

Mouse flt-1 VEGF Receptor-Hammerhead Ribozyme and Substrate Sequence

| nt. Position | HH Ribozyme | Substrate |
|---|---|---|
| 3149 | GCCAGGCC CUGAUGU X GAA AAGUCGCA | UGCGACUUU GGCCUGGC |
| 3165 | CUUAUAAA CUGAUGU X GAA AUCCCGGG | CCCGGGAUA UUUAUAAG |
| 3167 | UUCUUAUA CUGAUGU X GAA AUAUCCCG | CGGGAUAUU UAUAAGAA |
| 3168 | GUUCUUAU CUGAUGU X GAA AAUAUCCC | GGGAUAUUU AUAAGAAC |
| 3169 | GGUUCUUA CUGAUGU X GAA AAAUAUCC | GGAUAUUUA UAAGAACC |
| 3171 | AGGGUUCU CUGAUGU X GAA AUAAAUAU | AUAUUUAUA AGAACCCU |
| 3183 | CCUCACAU CUGAUGU X GAA AUCAGGGU | ACCCUGAUU AUGUGAGG |
| 3184 | UCCUCACA CUGAUGU X GAA AUCAGGG | CCCUGAUUA UGUGAGGA |
| 3201 | AAGUCGAG CUGAUGU X GAA AUCUCCUC | GAGGAGAUA CUCGACUU |
| 3204 | GGGAAGUC CUGAUGU X GAA AGUAUCUC | GAGAUACUC GACUUCCC |
| 3209 | UUUAGGGG CUGAUGU X GAA AGUCGAGU | ACUCGACUU CCCCUAAA |
| 3210 | UUUUAGGG CUGAUGU X GAA AAGUCGAG | CUCGACUUC CCCUAAAA |
| 3215 | AUCCAUUU CUGAUGU X GAA AGGGGAAG | CUUCCCCUA AAAUGGAU |
| 3228 | GGAUUCAG CUGAUGU X GAA AGCCAUCC | GGAUGGCUC CUGAAUCC |
| 3235 | CAAAGAUG CUGAUGU X GAA AUUCAGGA | UCCUGAAUC CAUCUUUG |
| 3239 | UUGUCAAA CUGAUGU X GAA AUGGAUUC | GAAUCCAUC UUUGACAA |
| 3241 | CCUUGUCA CUGAUGU X GAA AGAUGGAU | AUCCAUCUU UGACAAGG |
| 3242 | ACCUUGUC CUGAUGU X GAA AAGAUGGA | UCCAUCUUU GACAAGGU |
| 3251 | GUGCUGUA CUGAUGU X GAA ACCUUGUC | GACAAGGUC UACAGCAC |
| 3253 | UGGUGCUG CUGAUGU X GAA AGACCUUG | CAAGGUCUA CAGCACCA |
| 3277 | CGCCAUAG CUGAUGU X GAA ACCACACA | UGUGUGGUC CUAUGGCG |
| 3280 | ACACGCCA CUGAUGU X GAA AGGACCAC | GUGGUCCUA UGGCGUGU |
| 3289 | CCCACAGC CUGAUGU X GAA ACACGCCA | UGGCGUGUU GCUGUGGG |
| 3302 | AAGGAGAA CUGAUGU X GAA AUCUCCCA | UGGGAGAUC UUCUCCUU |
| 3304 | CUAAGGAG CUGAUGU X GAA AGAUCUCC | GGAGAUCUU CUCCUUAG |
| 3305 | CCUAAGGA CUGAUGU X GAA AAGAUCUC | GAGAUCUUC UCCUUAGG |
| 3307 | CCCCUAAG CUGAUGU X GAA AGAAGAUC | GAUCUUCUC CUUAGGGG |
| 3310 | AACCCCCU CUGAUGU X GAA AGGAGAAG | CUUCUCCUU AGGGGUU |
| 3311 | GAACCCCC CUGAUGU X GAA AAGGAGAA | UUCUCCUUA GGGGUUC |
| 3318 | GUAUGGAG CUGAUGU X GAA ACCCCCUA | UAGGGGGUU CACCAUAC |
| 3319 | GGUAUGGA CUGAUGU X GAA AACCCCCU | AGGGGUUC UCCAUACC |
| 3321 | UGGGUAUG CUGAUGU X GAA AGAACCCC | GGGGUUCUC CAUACCCA |
| 3325 | CUCCUGGG CUGAUGU X GAA AUGGAGAA | UUCUCCAUA CCCAGGAG |
| 3352 | GGCUGCAG CUGAUGU X GAA AGUCUUCA | UGAAGACUU CUGCAGCC |
| 3353 | CGGCUGCA CUGAUGU X GAA AAGUCUUC | GAAGACUUC UGCAGCCG |
| 3397 | GUGUGGCA CUGAUGU X GAA ACUCCGGG | CCCGGAGUA UGCCACAC |
| 3413 | AUUUGGUA CUGAUGU X GAA AUUUACGG | CCUGAAAUC UACCAAAU |

Table VIII-continued

Mouse flt-1 VEGF Receptor-Hammerhead Ribozyme and Substrate Sequence

| nt. Position | HH Ribozyme | Substrate |
|---|---|---|
| 3415 | UGAUUUGG CUGAUGU X GAA AGAUUUCA | UGAAAUCUA CCAAAUCA |
| 3422 | UCCAACAU CUGAUGU X GAA AUUUGGUA | UACCAAAUC AUGUUGGA |
| 3427 | AGCAAUCC CUGAUGU X GAA ACAUGAUU | AAUCAUGUU GGAUUGCU |
| 3432 | GUGCCAGC CUGAUGU X GAA AUCCAACA | UGUUGGAUU GCUGGCAC |
| 3466 | GUUCAGCA CUGAUGU X GAA ACCGGGGC | GCCCCGGUU UGCUGAAC |
| 3467 | AGUUCAGC CUGAUGU X GAA AACCGGGG | CCCCGGUUU GCUGAACU |
| 3476 | UUCUCCAC CUGAUGU X GAA AGUUCAGC | GCUGAACUU GUGGAGAA |
| 3488 | AGGUCACC CUGAUGU X GAA AGUUUCUC | GAGAAACUU GGUGACCU |
| 3500 | UUGGCUUG CUGAUGU X GAA AGCAGGUC | GACCUGCUU CAAGCCAA |
| 3501 | GUUGGCUU CUGAUGU X GAA AAGCAGGU | ACCUGCUUC AAGCCAAC |
| 3512 | UCCUGUUG CUGAUGU X GAA ACGUUGGC | GCCAACGUC AACAGGA |
| 3531 | GGGGAUGU CUGAUGU X GAA AUCUUUCC | GGAAAGAUU ACAUCCCC |
| 3532 | GGGGGAUG CUGAUGU X GAA AAUCUUUC | GAAAGAUUA CAUCCCCC |
| 3536 | UUGAGGGG CUGAUGU X GAA AUGUAAUC | GAUUACAUC CCCCUCAA |
| 3542 | AUGGCAUU CUGAUGU X GAA AGGGGGAU | AUCCCCCUC AAUGCCAU |
| 3551 | CUAGUCAG CUGAUGU X GAA AUGGCAUU | AAUGCCAUA CUGACUAG |
| 3558 | ACUGUUUC CUGAUGU X GAA AGUCAGUA | UACUGACUA GAAACAGU |
| 3567 | UGUGAAGC CUGAUGU X GAA ACUGUUUC | GAAACAGUA GCUUCACA |
| 3571 | AGUAUGUG CUGAUGU X GAA ACGUACUG | CAGUAGCUU CACAUACU |
| 3572 | GAGUAUGU CUGAUGU X GAA AAGCUACU | AGUAGCUUC ACAUACUC |
| 3577 | GGGUCGAG CUGAUGU X GAA AUGUGAAG | CUUCACAUA CUCGACCC |
| 3580 | UGGGGGUC CUGAUGU X GAA AGUAUGUG | CACAUACUC GACCCCCA |
| 3592 | CCUCAGAG CUGAUGU X GAA AGGUGGGG | CCCCACCUU CUCUGAGG |
| 3593 | UCCUCAGA CUGAUGU X GAA AAGGUGGG | CCCACCUUC UCUGAGGA |
| 3595 | GGUCCUCA CUGAUGU X GAA AGAAGGUG | CACCUUCUC UGAGGACC |
| 3605 | UCCUUGAA CUGAUGU X GAA AGGUCCUC | GAGGACCUU UUCAAGGA |
| 3606 | GUCCUUGA CUGAUGU X GAA AAGGUCCU | AGGACCUUU UCAAGGAC |
| 3607 | CGUCCUUG CUGAUGU X GAA AAAGGUCC | GGACCUUUU CAAGGACG |
| 3608 | CCGUCCUU CUGAUGU X GAA AAAAGGUC | GACCUUUUC AAGGACGG |
| 3619 | GAUCUGCA CUGAUGU X GAA AGCCGUCC | GGACGGCUU UGCAGAUC |
| 3620 | GGAUCUGC CUGAUGU X GAA AAGCCGUC | GACGGCUUU GCAGAUCC |
| 3627 | AAAAUGUG CUGAUGU X GAA AUCUGCAA | UUGCAGAUC CACAUUUU |
| 3633 | GGAAUGAA CUGAUGU X GAA AUGUGGAU | AUCCACAUU UUCAUUCC |
| 3634 | CGGAAUGA CUGAUGU X GAA AAUGUGGA | UCCACAUUU UCAUUCCG |
| 3635 | CCGGAAUG CUGAUGU X GAA AAAUGUGG | CCACAUUUU CAUUCCGG |
| 3636 | UCCGGAAU CUGAUGU X GAA AAAAUGUG | CACAUUUUC AUUCCGGA |

Table VIII-continued

Mouse flt-1 VEGF Receptor-Hammerhead Ribozyme and Substrate Sequence

| nt. Position | HH Ribozyme | Substrate |
|---|---|---|
| 3639 | GCUUCCGG CUGAUGU X GAA AUGAAAAU | AUUUUCAUU CCGGAAGC |
| 3640 | AGCUUCCG CUGAUGU X GAA AAUGAAAA | UUUUCAUUC CGGAAGCU |
| 3649 | CAUCAUCA CUGAUGU X GAA AGCUUCCG | CGGAAGCUC UGAUGAUG |
| 3664 | CGUUUACA CUGAUGU X GAA AUCUCACA | UGUGAGAUA UGUAAACG |
| 3668 | AAAGCGUU CUGAUGU X GAA ACAUAUCU | AGAUAUGUA AACGCUUU |
| 3675 | GAAUUUGA CUGAUGU X GAA AGCGUUUA | UAAACGCUU UCAAAUUC |
| 3676 | UGAAUUUG CUGAUGU X GAA AAGCGUUU | AAACGCUUU CAAAUUCA |
| 3677 | AUGAAUUU CUGAUGU X GAA AAAGCGUU | AACGCUUUC AAAUUCAU |
| 3682 | GGCUCAUG CUGAUGU X GAA AUUUCAAA | UUUCAAAUU CAUGAGCC |
| 3683 | AGGCUCAU CUGAUGU X GAA AAUUUGAA | UUCAAAUUC AUGAGCCU |
| 3701 | AAGGUUUU CUGAUGU X GAA AUUCUUUC | GAAAGAAUC AAAACCUU |
| 3709 | GCUCCUCA CUGAUGU X GAA AGGUUUUG | CAAAACCUU UGAGGAGC |
| 3710 | AGCUCCUC CUGAUGU X GAA AAGGUUUU | AAAACCUUU GAGGAGCU |
| 3719 | UUCGGUGA CUGAUGU X GAA AGCUCCUC | GAGGAGCUU UCACCGAA |
| 3720 | GUUCGGUG CUGAUGU X GAA AAGCUCCU | AGGAGCUUU CACCGAAC |
| 3721 | AGUUCGGU CUGAUGU X GAA AAAGCUCC | GGAGCUUUC ACCGAACU |
| 3730 | UGGAGGUG CUGAUGU X GAA AGUUCGGU | ACCGAACUC CACCUCCA |
| 3736 | CAAACAUG CUGAUGU X GAA AGGUGGAG | CUCCACCUC CAUGUUUG |
| 3742 | AGUCCUCA CUGAUGU X GAA ACAUGGAG | CUCCAUGUU UGAGGACU |
| 3743 | UAGUCCUC CUGAUGU X GAA AACAUGAG | UCCAUGUUU GAGGACUA |
| 3751 | CCAGCUGA CUGAUGU X GAA AGUCCUCA | UGAGGACUA UCAGCUGG |
| 3753 | GUCCAGCU CUGAUGU X GAA AUAGUCCU | AGGACUAUC AGCUGGAC |
| 3765 | CAGAGUGC CUGAUGU X GAA AGUGUCCA | UGGACACUA GCACUCUG |
| 3771 | GCCCAGCA CUGAUGU X GAA AGUGCUAG | CUAGCACUC UGCUGGGC |
| 3781 | GCAAGGGG CUGAUGU X GAA AGCCCAGC | GCUGGGCUC CCCCUUGC |
| 3787 | GCUUCAGC CUGAUGU X GAA AGGGGGAG | CUCCCCCUU GCUGAAGC |
| 3799 | UCCAGGUG CUGAUGU X GAA ACCGCUUC | GAAGCGGUU CACCUGGA |
| 3800 | GUCCAGGU CUGAUGU X GAA AACCGCUU | AAGCGGUUC ACCUGGAC |
| 3829 | UCUUCAUG CUGAUGU X GAA AGGCCUUG | CAAGGCCUC CAUGAAGA |
| 3839 | CUCAAGUC CUGAUGU X GAA AUCUUCAU | AUGAAGAUA GACUUGAG |
| 3844 | CUAUUCUC CUGAUGU X GAA AGUCUAUC | GAUAGACUU GAGAAUAG |
| 3851 | UUACUCGC CUGAUGU X GAA AUUCUCAA | UUGAGAAUA GCGAGUAA |
| 3858 | CUUGCUUU CUGAUGU X GAA ACUCGCUA | UAGCGAGUA AAAGCAAG |
| 3878 | AGAUCGGA CUGAUGU X GAA AGUCCCGC | GCGGGACUU UCCGAUCU |
| 3879 | CAGAUCGG CUGAUGU X GAA AAGUCCCG | CGGGACUUU CCGAUCUG |
| 3880 | GCAGAUCG CUGAUGU X GAA AAAGUCCC | GGGACUUUC CGAUCUGC |
| 3885 | AUCGGAAA CUGAUGU X GAA AUCGGAAA | UUUCCGAUC UGCCGAGG |

Table VIII-continued

Mouse flt-1 VEGF Receptor-Hammerhead Ribozyme and Substrate Sequence

| nt. Position | HH Ribozyme | Substrate |
|---|---|---|
| 3901 | AGCUGGGC CUGAUGU X GAA AGCUGGGC | GCCCAGCUU CUGCUUCU |
| 3902 | AAGCUGGG CUGAUGU X GAA AAGCUGGG | CCCAGCUUC UGCUUCUC |
| 3907 | AGCUGGAG CUGAUGU X GAA AGCAGAAG | CUUCUGCUU CUCCAGCU |
| 3908 | CAGCUGGA CUGAUGU X GAA AAGCAGAA | UUCUGCUUC UCCAGCUG |
| 3910 | CACAGCUG CUGAUGU X GAA AGAAGCAG | CUGCUUCUC CAGCUGUG |
| 3926 | ACGGGCCU CUGAUGU X GAA AUGUGGCC | GGCCACAUC AGGCCCGU |
| 3949 | CCAGCUCA CUGAUGU X GAA AUUCAUCG | CGAUGAAUC UGAGCUGG |
| 3967 | AACAGCAG CUGAUGU X GAA ACUCCUUU | AAAGGAGUC CUGCUGUU |
| 3975 | GGGUGGAG CUGAUGU X GAA ACAGCAGG | CCUGCUGUU CUCCACCC |
| 3976 | GGGGUGGA CUGAUGU X GAA AACAGCAG | CUGCUGUUC UCCACCCC |
| 3978 | UGGGGGUG CUGAUGU X GAA AGAACAGC | GCUGUUCUC CACCCCCA |
| 3991 | CGGAGUUG CUGAUGU X GAA AGUCUGGG | CCCAGACUA CAACUCCG |
| 3997 | ACACCACG CUGAUGU X GAA AGUUGUAC | CUACAACUC CGUGGUGU |
| 4006 | AGGAGUAC CUGAUGU X GAA ACACCACG | CGUGGUGUU GUACUCCU |
| 4009 | GGGAGGAG CUGAUGU X GAA ACAACACC | GGUGUUGUA CUCCUCCC |
| 4012 | GCGGGGAG CUGAUGU X GAA AGUACAAC | GUUGUACUC CUCCCCGC |
| 4015 | CGGGCGGG CUGAUGU X GAA AGGAGUAC | GUACUCCUC CCCGCCCG |
| 4027 | AGAAGCUU CUGAUGU X GAA AGGCGGGC | GCCCGCCUA AAGCUUCU |
| 4033 | CUGGUGAG CUGAUGU X GAA AGCUUUAG | CUAAAGCUU CUCACCAG |
| 4034 | GCUGGUGA CUGAUGU X GAA AAGCUUUA | UAAAGCUUC UCACCAGC |
| 4036 | GGGCUGGU CUGAUGU X GAA AGAAGCUU | AAGCUUCUC ACCAGCCC |
| 4066 | AUGUAUAA CUGAUGU X GAA ACUGUCAG | CUGACAGUA UUAUACAU |
| 4068 | AGAUGUAU CUGAUGU X GAA AUACUGUC | GACAGUAUU AUACAUCU |
| 4069 | UAGAUGUA CUGAUGU X GAA AAUACUGU | ACAGUAUUA UACAUCUA |
| 4071 | CAUAGAUG CUGAUGU X GAA AUAAUACU | AGUAUUAUA CAUCUAUG |
| 4075 | AACUCAUA CUGAUGU X GAA AUGUAUAA | UUAUACAUC UAUGAGUU |
| 4077 | UAAACUCA CUGAUGU X GAA AGAUGUAU | AUACAUCUA UGAGUUUA |
| 4083 | UAGGUGUA CUGAUGU X GAA ACUCAUAG | CUAUGAGUU UACACCUA |
| 4084 | AUAGGUGU CUGAUGU X GAA AACUCAUA | UAUGAGUUU ACACCUAU |
| 4085 | AAUAGGUG CUGAUGU X GAA AAACUCAU | AUGUGUUUA CACCUAUU |
| 4091 | GAGCGGAA CUGAUGU X GAA AGGUGUAA | UUACACCUA UUCCGCUC |
| 4093 | UGGAGCGG CUGAUGU X GAA AUAGGUGU | ACACCUAUU CCGCUCCA |
| 4094 | GUGGAGCG CUGAUGU X GAA AAUAGGUG | CACCUAUUC CGCUCCAC |
| 4099 | CUCCUGUG CUGAUGU X GAA AGCGGAAU | AUUCCGCUC CACAGGAG |
| 4117 | GUCACGAA CUGAUGU X GAA AGCAGCUG | CAGCUGCUU UUCGUGAC |
| 4118 | GGUCACGA CUGAUGU X GAA AAGCAGCU | AGCUGCUUU UCGUGACC |

Table VIII-continued

Mouse flt-1 VEGF Receptor-Hammerhead Ribozyme and Substrate Sequence

| nt. Position | HH Ribozyme | Substrate |
|---|---|---|
| 4119 | AGGUCACG CUGAUGU X GAA AAAGCAGC | GCUGCUUUU CGUGACCU |
| 4120 | AAGGUCAC CUGAUGU X GAA AAAAGCAG | CUGCUUUUC GUGACCUU |
| 4128 | CACGAUUA CUGAUGU X GAA AGGUCACG | CGUGACCUU UAAUCGUG |
| 4129 | GACAGAUU CUGAUGU X GAA AAGGUCAC | GUGACCUUU AAUCGUGC |
| 4130 | AGCACGAU CUGAUGU X GAA AAAGGUCA | UGACCUUUA AUCGUGCU |
| 4133 | AAAAGCAC CUGAUGU X GAA AUUAAAGG | CCUUUAAUC GUGCUUUU |
| 4139 | AAACAAAA CUGAUGU X GAA AGCACGAU | AUCGUGCUU UUUUGUUU |
| 4140 | AAAACAAA CUGAUGU X GAA AAGCACGA | UCGUGCUUU UUUGUUUU |
| 4141 | AAAAACAA CUGAUGU X GAA AAAGCACG | CGUGCUUUU UUGUUUUU |
| 4142 | AAAAAACA CUGAUGU X GAA AAAAGCAC | GUGCUUUUU UGUUUUUU |
| 4143 | CAAAAAAC CUGAUGU X GAA AAAAAGCA | UGCUUUUUU GUUUUUUG |
| 4146 | AAACAAAA CUGAUGU X GAA ACAAAAAA | UUUUUUGUU UUUUGUUU |
| 4147 | AAAACAAA CUGAUGU X GAA AACAAAAA | UUUUUGUUU UUUGUUUU |
| 4148 | CAAAACAA CUGAUGU X GAA AAACAAAA | UUUUGUUUU UUGUUUUG |
| 4149 | ACAAAACA CUGAUGU X GAA AAAACAAA | UUUGUUUUU UGUUUUGU |
| 4150 | AACAAAAC CUGAUGU X GAA AAAAACAA | UUGUUUUUU GUUUUGUU |
| 4153 | ACAACAA CUGAUGU X GAA ACAAAAAA | UUUUUUGUU UUGUUUGU |
| 4154 | AACAAACA CUGAUGU X GAA AACAAAAA | UUUUUGUUU UGUUUGUU |
| 4155 | CAACAAAC CUGAUGU X GAA AAACAAAA | UUUUGUUUU GUUUGUUG |
| 4158 | CAACAACA CUGAUGU X GAA ACAAAACA | UGUUUUGUU UGUUGUUG |
| 4159 | GCAACAAC CUGAUGU X GAA AACAAAAC | GUUUUGUUU GUUGUUGC |
| 4162 | ACAGCAAC CUGAUGU X GAA ACAAACAA | UUGUUUGUU GUUGCUCU |
| 4165 | AAAACAGC CUGAUGU X GAA ACAACAAA | UUUGUUGUU GCUGUUUU |
| 4171 | UUAGUCAA CUGAUGU X GAA ACAGCAAC | GUUGCUGUU UUGACUAA |
| 4172 | GUUAGUCA CUGAUGU X GAA AACAGCAA | UUGCUGUUU UGACUAAC |
| 4173 | UGUUAGUC CUGAUGU X GAA AAACAGCA | UGCUGUUUU GACUAACA |
| 4178 | AUUCUUGU CUGAUGU X GAA AGUCAAAA | UUUUGACUA ACAAGAAU |
| 4189 | ACUGGGGU CUGAUGU X GAA ACAUUCUU | AAGAAUGUA ACCCCAGU |
| 4198 | ACGUCACU CUGAUGU X GAA ACUGGGGU | ACCCCAGUU AGUGACGU |
| 4199 | CACGUCAC CUGAUGU X GAA AACUGGGG | CCCCAGUUA GUGACGUG |
| 4216 | AACAAUAG CUGAUGU X GAA AUUCUUCA | UGAAGAAUA CUAUUGUU |
| 4219 | UCUAACAA CUGAUGU X GAA AGUAUUCU | AGAAUACUA UUGUUAGA |
| 4221 | UCUCUAAC CUGAUGU X GAA AUAGUAUU | AAUACUAUU GUUAGAGA |
| 4224 | AUUUCUCU CUGAUGU X GAA ACAAUAGU | ACUAUUGUU AGAGAAAU |
| 4225 | GAUUUCUC CUGAUGU X GAA AACAAUAG | CUAUUGUUA GAGAAAUC |
| 4233 | GCGGGGGG CUGAUGU X GAA AUUUCUCU | AGAGAAAUC CCCCCCGC |
| 4249 | GUUACCCU CUGAUGU X GAA AGGCUUUG | CAAAGCCUC AGGGUAAC |

Table VIII-continued

Mouse flt-1 VEGF Receptor-Hammerhead Ribozyme and Substrate Sequence

| nt. Position | HH Ribozyme | Substrate |
|---|---|---|
| 4255 | GUCCAGGU CUGAUGU X GAA ACCCUGAG | CUCAGGGUA ACCUGGAC |
| 4282 | GGUCGCCA CUGAUGU X GAA AGGCACCU | AGGUGCCUC UGGCGACC |
| 4323 | GCUGCAGG CUGAUGU X GAA AGGGUGGG | CCCACCCUC CCUGCAGC |
| 4341 | ACUGCCUC CUGAUGU X GAA AGUCCCAC | GUGGGACUA GAGGCAGU |
| 4350 | AAUGGGCU CUGAUGU X GAA ACUGCCUC | GAGGCAGUA AGCCCAUU |
| 4358 | CAUGAGCU CUGAUGU X GAA AUGGGCUU | AAGCCCAUU AGCUCAUG |
| 4359 | CCAUGAGC CUGAUGU X GAA AAUGGGCU | AGCCCAUUA GCUCAUGG |
| 4363 | GCAGCCAU CUGAUGU X GAA AGCUAAUG | CAUUAGCUC AUGGCUGC |
| 4387 | GAGAGACA CUGAUGU X GAA AGCAGGUC | GACCUGCUC UGUCUCUC |
| 4391 | AUAAGAGA CUGAUGU X GAA ACAGAGCA | UGCUCUGUC UCUCUUAU |
| 4393 | CCAUAAGA CUGAUGU X GAA AGACAGAG | CUCUGUCUC UCUUAUGG |
| 4395 | CUCCAUAA CUGAUGU X GAA AGAGACAG | CUGUCUCUC UUAUGGAG |
| 4397 | UCCUCCAU CUGAUGU X GAA AGAGAGAC | GUCUCUCUU AUGGAGGA |
| 4398 | UUCCUCCA CUGAUGU X GAA AAGAGAGA | UCUCUCUUA UGGAGGAA |
| 4445 | GCAUCCCA CUGAUGU X GAA AGCCUUUU | AAAAGGCUU UGGGAUGC |
| 4446 | CGCAUCCC CUGAUGU X GAA AAGCCUUU | AAAGGCUUU GGGAUGCG |
| 4456 | ACAGGACG CUGAUGU X GAA ACGCAUCC | GGAUGCGUC CGUCCUGU |
| 4460 | CUCCACAG CUGAUGU X GAA ACGGACGC | GCGUCCGUC CUGUGGAG |
| 4487 | GCAUAGCG CUGAUGU X GAA AGCCCCCU | AGGGGGCUC CGCUAUGC |
| 4492 | AAGUGGCA CUGAUGU X GAA AGCGGAGC | GCUCCGCUA UGCCACUU |
| 4500 | AGUCACUG CUGAUGU X GAA AGUGGCAU | AUGCCACUU CAGUGACU |
| 4501 | AAGUCACU CUGAUGU X GAA AAGUGGCA | UGCCACUUC AGUGACUU |
| 4509 | GGAGUGAG CUGAUGU X GAA AGUCACUG | CAGUGACUU CUCACUCC |
| 4510 | AGGAGUGA CUGAUGU X GAA AAGUCACU | AGUGACUUC UCACUCCU |
| 4512 | CCAGGAGU CUGAUGU X GAA AGAAGUCA | UGACUUCUC ACUCCUGG |
| 4516 | GAGGCCAG CUGAUGU X GAA AGUGAGAA | UUCUCACUC CUGGCCUC |
| 4524 | AAACAGCG CUGAUGU X GAA AGGCCAGG | CCUGGCCUC CGCUGUUU |
| 4531 | GGGCCCGA CUGAUGU X GAA ACAGCGGA | UCCGCUGUU UCGGGCCC |
| 4532 | GGGGCCCG CUGAUGU X GAA AACAGCGG | CCGCUGUUU CGGGCCCC |
| 4533 | GGGGGCCC CUGAUGU X GAA AAACAGCG | CGCUGUUUC GGGCCCCC |
| 4543 | CCUCUUGG CUGAUGU X GAA AGGGGGCC | GGCCCCCUU CCAAGAGG |
| 4544 | ACCUCUUG CUGAUGU X GAA AAGGGGGC | GCCCCCUUC CAAGAGGU |
| 4553 | UGCUCUGA CUGAUGU X GAA ACCUCUUG | CAAGAGGUA UCAGAGCA |
| 4555 | UCUGCUCU CUGAUGU X GAA AUACCUCU | AGAGGUAUC AGAGCAGA |
| 4577 | GUCUAGGA CUGAUGU X GAA ACGUCCCU | AGGGACGUU UCCUAGAC |
| 4578 | GGUCUAGG CUGAUGU X GAA AACGUCCC | GGGACGUUU CCUAGACC |

Table VIII-continued

Mouse flt-1 VEGF Receptor-Hammerhead Ribozyme and Substrate Sequence

| nt. Position | HH Ribozyme | Substrate |
|---|---|---|
| 4579 | UGGUCUAG CUGAUGU X GAA AAACGUCC | GGACGUUUC CUAGACCA |
| 4582 | CCCUGGUC CUGAUGU X GAA AGGAAACG | CGUUUCCUA GACCAGGG |
| 4598 | UUCCCGAG CUGAUGU X GAA ACAUGUGC | GCACAUGUU CUCGGGAA |
| 4599 | GUUCCCGA CUGAUGU X GAA AACAUGUG | CACAUGUUC UCGGGAAC |
| 4601 | UGGUUCCC CUGAUGU X GAA AGAACAUG | CAUGUUCUC GGGAACCA |
| 4614 | UUAAGAUU CUGAUGU X GAA ACUGUGGU | ACCACAGUU AAUCUUAA |
| 4615 | UUUAAGAU CUGAUGU X GAA AACUGUGG | CCACAGUUA AUCUUAAA |
| 4618 | AGAUUUAA CUGAUGU X GAA AUUAACUG | CAGUUAAUC UUAAAUCU |
| 4620 | AAAGAUUU CUGAUGU X GAA AGAUUAAC | GUUAAUCUU AAAUCUUU |
| 4621 | AAAAGAUU CUGAUGU X GAA AAGAUUAA | UUAAUCUUA AAUCUUUU |
| 4625 | CGGGAAAA CUGAUGU X GAA AUUUAAGA | UCUUAAAUC UUUUCCCG |
| 4627 | CCCGGGAA CUGAUGU X GAA AGAUUUAA | UUAAAUCUU UUCCCGGG |
| 4628 | UCCCGGGA CUGAUGU X GAA AAGAUUUA | UAAAUCUUU UCCCGGGA |
| 4629 | CUCCCGGG CUGAUGU X GAA AAAGAUUU | AAAUCUUUU CCCGGGAG |
| 4630 | ACUCCCGG CUGAUGU X GAA AAAAGAUU | AAUCUUUUC CCGGGAGU |
| 4639 | CAACAGAA CUGAUGU X GAA ACUCCCGG | CCGGGAGUC UUCUGUUG |
| 4641 | GACAACAG CUGAUGU X GAA AGACUCCC | GGGAGUCUU CUGUUGUC |
| 4642 | AGACAACA CUGAUGU X GAA AAGACUUC | GGAGUCUUC UGUUGUCU |
| 4646 | AAACAGAC CUGAUGU X GAA ACAGAAGA | UCUUCUGUU GUCUGUUU |
| 4649 | GGUAAACA CUGAUGU X GAA ACAACAGA | UCUGUUGUC UGUUUACC |
| 4653 | GGAUGGUA CUGAUGU X GAA ACAGACAA | UUGUCUGUU UACCAUCC |
| 4654 | UGGAUGGU CUGAUGU X GAA AACAGACA | UGUCUGUUU ACCAUCCA |
| 4655 | UUGGAUGG CUGAUGU X GAA AAACAGAC | GUCUGUUUA CCAUCCAA |
| 4660 | AUGCUUUG CUGAUGU X GAA AUGGUAAA | UUUACCAUC CAAAGCAU |
| 4669 | AUGUUAAA CUGAUGU X GAA AUGCUUUG | CAAAGCAUA UUUAACAU |
| 4671 | ACAUGUUA CUGAUGU X GAA AUAUGCUU | AAGCAUAUU UAACAUGU |
| 4672 | CACAUGUU CUGAUGU X GAA AAUAUGCU | AGCAUAUUU AACAUGUG |
| 4673 | ACACAUGU CUGAUGU X GAA AAAUAUGC | GCAUAUUUA ACAUGUGU |
| 4682 | CCCCCACU CUGAUGU X GAA ACACAUGU | ACAUGUGUC AGUGGGGG |
| 4698 | CAGAAGCC CUGAUGU X GAA AGCGCCAC | GUGGCGCUU GGCUUCUG |
| 4703 | GGCCUCAG CUGAUGU X GAA AGCCAAGC | GCUUGGCUU CUGAGGCC |
| 4704 | UGGCCUCA CUGAUGU X GAA AACGGAAG | CUUGGCUUC UGAGGCCA |
| 4720 | GAACUGAU CUGAUGU X GAA AUGGCUCU | AGAGCCAUC AUCAGUUC |
| 4723 | GAGGAACU CUGAUGU X GAA AUGAUGGC | GCCAUCAUC AGUUCCUC |
| 4727 | ACUAGAGG CUGAUGU X GAA ACUGAUGA | UCAUCAGUU CCUCUAGU |
| 4728 | CACUAGAG CUGAUGU X GAA AACUGAUG | CAUCAGUUC CUCUAGUG |
| 4731 | UCUCACUA CUGAUGU X GAA AGGAACUG | CAGUUCCUC UAGUGAGA |

Table VIII-continued

Mouse flt-1 VEGF Receptor-Hammerhead Ribozyme and Substrate Sequence

| nt. Position | HH Ribozyme | Substrate |
|---|---|---|
| 4733 | CAUCUCAC CUGAUGU X GAA AGAGGAAC | GUUCCUCUA GUGAGAUG |
| 4745 | AUGACCUC CUGAUGU X GAA AUGCAUCU | AGAUGCAUU GAGGUCAU |
| 4751 | UUGGGUAU CUGAUGU X GAA ACCUCAAU | AUUGAGGUC AUACCCAA |
| 4754 | AGCUUGGG CUGAUGU X GAA AUGACCUC | GAGGUCAUA CCCAAGCU |
| 4763 | AGGCCUGC CUGAUGU X GAA AGCUUGGG | CCCAAGCUU GCAGGCCU |
| 4777 | AGUAUGCG CUGAUGU X GAA AGGUCAGG | CCUGACCUU CGCAUACU |
| 4778 | CAGUAUGC CUGAUGU X GAA AAGGUCAG | CUGACCUUC GCAUACUG |
| 4783 | GUGAGCAG CUGAUGU X GAA AUGCGAAG | CUUCGCAUA CUGCUCAC |
| 4789 | CUCCCCGU CUGAUGU X GAA AGCAGUAU | AUACUGCUC ACGGGGAG |
| 4799 | GACCACUU CUGAUGU X GAA ACUCCCCG | CGGGGAGUU AAGUGGUC |
| 4800 | GGACCACU CUGAUGU X GAA AACUCCCC | GGGGAGUUA AGUGGUCC |
| 4807 | CCAAACUG CUGAUGU X GAA ACCACUUA | UAAGUGGUC CAGUUUGG |
| 4812 | CUAGGCCA CUGAUGU X GAA ACUGGACC | GGUCCAGUU UGGCCUAG |
| 4813 | ACUAGGCC CUGAUGU X GAA AACUGGAC | GUCCAGUUU GGCCUAGU |
| 4819 | AACCUUAC CUGAUGU X GAA AGGCCAAA | UUUGGCCUA GUAAGGUU |
| 4822 | GGCAACCU CUGAUGU X GAA ACUAGGCC | GGCCUAGUA AGGUUGCC |
| 4827 | CAGUAGGC CUGAUGU X GAA ACCUUACU | AGUAAGGUU GCCUACUG |
| 4832 | CCCAUCAG CUGAUGU X GAA AGGCAACC | GGUUGCCUA CUGAUGGG |
| 4843 | UGGCUUUU CUGAUGU X GAA AGCCCAUC | GAUGGGCUC AAAAGCCA |
| 4855 | CUGUUUAA CUGAUGU X GAA AUGUGGCU | AGCCACAUU UUAAACAG |
| 4856 | CCUGUUUA CUGAUGU X GAA AAUGUGGC | GCCACAUUU UAAACAGG |
| 4857 | ACCUGUUU CUGAUGU X GAA AAAUGUGG | CCACAUUUU AAACAGGU |
| 4858 | AACCUGUU CUGAUGU X GAA AAAAUGUG | CACAUUUUA AACAGGUU |
| 4866 | UGAGAUAA CUGAUGU X GAA ACCUGUUU | AAACAGGUU UUAUCUCA |
| 4867 | UUGAGAUA CUGAUGU X GAA AACCUGUU | AACAGGUUU UAUCUCAA |
| 4868 | CUUGAGAU CUGAUGU X GAA AAACCUGU | ACAGGUUUU AUCUCAAG |
| 4869 | ACUUGAGA CUGAUGU X GAA AAAACCUG | CAGGUUUUA UCUCAAGU |
| 4871 | AUACUUGA CUGAUGU X GAA AUAAAACC | GGUUUUAUC UCAAGUAU |
| 4873 | UAAUACUU CUGAUGU X GAA AGAUAAAA | UUUUAUCUC AAGUAUUA |
| 4878 | UAUAUUAA CUGAUGU X GAA ACUUGAGA | UCUCAAGUA UUAAUAUA |
| 4880 | UAUAUAUU CUGAUGU X GAA AUACUUGA | UCAAGUAUU AAUAUAUA |
| 4881 | CUAUAUAU CUGAUGU X GAA AAUACUUG | CAAGUAUUA AUAUAUAG |
| 4884 | UGUCUAUA CUGAUGU X GAA AUUAAUAC | GUAUUAAUA UAUAGACA |
| 4886 | CUUGUCUA CUGAUGU X GAA AUAUUAAU | AUUAAUAUA UAGACAAG |
| 4888 | GUCUUGUC CUGAUGU X GAA AUAUAUUA | UAAUAUAUA GACAAGAC |
| 4900 | UAAUGCAU CUGAUGU X GAA AGUGUCUU | AAGACACUU AUGCAUUA |

Table VIII-continued

Mouse flt-1 VEGF Receptor-Hammerhead Ribozyme and Substrate Sequence

| nt. Position | HH Ribozyme | Substrate |
|---|---|---|
| 4901 | AUAAUGCA CUGAUGU X GAA AAGUGUCU | AGACACUUA UGCAUUAU |
| 4907 | AACAGGAU CUGAUGU X GAA AUGCAUAA | UUAUGCAUU AUCCUGUU |
| 4908 | AAACAGGA CUGAUGU X GAA AAUGCAUA | UAUGCAUUA UCCGUUU |
| 4910 | UAAAACAG CUGAUGU X GAA AUAAUGCA | UGCAUUAUC CGUUUUA |
| 4915 | AUAUAUAA CUGAUGU X GAA ACAGGAUA | UAUCCUGUU UUAUAUAU |
| 4916 | GAUAUAUA CUGAUGU X GAA AACAGGAU | AUCCUGUUU UAUAUAUC |
| 4917 | GGAUAUAU CUGAUGU X GAA AAACAGGA | UCCUGUUUU AUAUAUCC |
| 4918 | UGGAUAUA CUGAUGU X GAA AAAACAGG | CCUGUUUUA UAUAUCCA |
| 4920 | AUUGGAUA CUGAUGU X GAA AUAAAACA | UGUUUUAUA UAUCCAAU |
| 4922 | UCAUUGGA CUGAUGU X GAA AUAUAAAA | UUUUAUAUA UCCAAUGA |
| 4924 | AUUCAUUG CUGAUGU X GAA AUAUAUAA | UUAUAUAUC CAAUGAAU |
| 4933 | CCCAGUUA CUGAUGU X GAA AUUCAUUG | CAAUGAAUA UAACUGGG |
| 4935 | GCCCCAGU CUGAUGU X GAA AUAUUCAU | AUGAAUAUA ACUGGGGC |
| 4948 | UGACUCUU CUGAUGU X GAA ACUCGCCC | GGGCGAGUU AAGAGUCA |
| 4949 | AUGACUCU CUGAUGU X GAA AACUCGCC | GGCGAGUUA AGAGUCAU |
| 4955 | UAGACCAU CUGAUGU X GAA ACUCUUAA | UUAAGAGUC AUGGUCUA |
| 4961 | CUUUUCUA CUGAUGU X GAA ACCAUGAC | GUCAUGGUC UAGAAAAG |
| 4963 | CCCUUUUC CUGAUGU X GAA AGACCAUG | CAUGGUCUA GAAAAGGG |
| 4974 | UACAGAGA CUGAUGU X GAA ACCCCUUU | AAAGGGGUU UCUCUGUA |
| 4975 | GUACAGAG CUGAUGU X GAA AACCCCUU | AAGGGGUUU CUCUGUAC |
| 4976 | GGUACAGA CUGAUGU X GAA AAACCCCU | AGGGGUUUC UCUGUACC |
| 4978 | UGGGUACA CUGAUGU X GAA AGAAACCC | GGGUUUCUC UGUACCCA |
| 4982 | GAUUUGGG CUGAUGU X GAA ACAGAGAA | UUCUCUGUA CCCAAAUC |
| 4990 | ACCAGCCC CUGAUGU X GAA AUUUGGGU | ACCCAAAUC GGGCUGGU |
| 4999 | CUUGGUCC CUGAUGU X GAA ACCAGCCC | GGGCUGGUU GGACCAAG |
| 5029 | GCUGGGAC CUGAUGU X GAA ACCACUCU | AGAGUGGUU GUCCCAGC |
| 5032 | AUAGCUGG CUGAUGU X GAA ACAACCAC | GUGGUUGUC CCAGCUAU |
| 5039 | AGUAACUA CUGAUGU X GAA AGCUGGGA | UCCCAGCUA UAGUUACU |
| 5041 | UUAGUAAC CUGAUGU X GAA AUAGCUGG | CCAGCUAUA GUUACUAA |
| 5044 | AGUUUAGU CUGAUGU X GAA ACUAUAGC | GCUAUAGUU ACUAAACU |
| 5045 | UAGUUUAG CUGAUGU X GAA AACUAUAG | CUAUAGUUA CUAAACUA |
| 5048 | GAGUAGUU CUGAUGU X GAA AGUAACUA | UAGUUACUA AACUACUC |
| 5053 | UGGGUGAG CUGAUGU X GAA AGUUUAGU | ACUAAACUA CUCACCCA |
| 5056 | CUUUGGGU CUGAUGU X GAA AGUAGUUU | AAACUACUC ACCCAAAG |
| 5066 | GAGGUCCC CUGAUGU X GAA ACUUUGGG | CCCAAAGUU GGGACCUC |
| 5074 | AAGCCAGU CUGAUGU X GAA AGGUCCCA | UGGGACCUC ACUGGCUU |
| 5082 | GUAAAGAG CUGAUGU X GAA AGCCAGUG | CACUGGCUU CUCUUUAC |

Table VIII-continued

Mouse flt-1 VEGF Receptor-Hammerhead Ribozyme and Substrate Sequence

| nt. Position | HH Ribozyme | Substrate |
|---|---|---|
| 5083 | AGUAAAGA CUGAUGU X GAA AAGCCAGU | ACUGGCUUC UCUUUACU |
| 5085 | GAAGUAAA CUGAUGU X GAA AGAAGCCA | UGGCUUCUC UUUACUUC |
| 5087 | AUGAAGUA CUGAUGU X GAA AGAGAAGC | GCUUCUCUU UACUUCAU |
| 5088 | GAUGAAGU CUGAUGU X GAA AAGAGAAG | CUUCUCUUU ACUUCAUC |
| 5089 | UGAUGAAG CUGAUGU X GAA AAAGAGAA | UUCUCUUUA CUUCAUCA |
| 5092 | CCAUGAUG CUGAUGU X GAA AGUAAAGA | UCUUUACUU CAUCAUGG |
| 5093 | UCCAUGAU CUGAUGU X GAA AAGUAAAG | CUUUACUUC AUCAUGGA |
| 5096 | AAAUCCAU CUGAUGU X GAA AUGAAGUA | UACUUCAUC AUGGAUUU |
| 5103 | GAUGGUGA CUGAUGU X GAA AUCCAUGA | UCAUGGAUU UCACCAUC |
| 5104 | GGAUGGUG CUGAUGU X GAA AAUCCAUG | CAUGGAUUU CACCAUCC |
| 5105 | GGGAUGGU CUGAUGU X GAA AAAUCCAU | AUGGAUUUC ACCAUCCC |
| 5111 | UGCCUUGG CUGAUGU X GAA AUGGUGAA | UUCACCAUC CCAAGGCA |
| 5122 | UCCUCUCA CUGAUGU X GAA ACUGCCUU | AAGGCAGUC UGAGAGGA |
| 5134 | AUACUCUU CUGAUGU X GAA AGCUCCUC | GAGGAGCUA AAGAGUAU |
| 5141 | UGGGCUGA CUGAUGU X GAA ACUCUUUA | UAAAGAGUA UCAGCCCA |
| 5143 | UAUGGGCU CUGAUGU X GAA AUACUCUU | AAGAGUAUC AGCCCAUA |
| 5151 | UUAAUAAA CUGAUGU X GAA AUGGGCUG | CAGCCCAUA UUUAUUAA |
| 5153 | GCUUAAUA CUGAUGU X GAA AUAUGGGC | GCCCAUAUU UAUUAAGC |
| 5154 | UGCUUAAU CUGAUGU X GAA AAUAUGGG | CCCAUAUUU AUUAAGCA |
| 5155 | GUGCUUAA CUGAUGU X GAA AAAUAUGG | CCAUAUUUA UUAAGCAC |
| 5157 | AAGUGCUU CUGAUGU X GAA AUAAAUAU | AUAUUUAUU AAGCACUU |
| 5158 | AAAGUGCU CUGAUGU X GAA AAUAAAUA | UAUUUAUUA AGCACUUU |
| 5165 | GGAGCAUA CUGAUGU X GAA AGUGCUUA | UAAGCACUU UAUGCUCC |
| 5166 | AGGAGCAU CUGAUGU X GAA AAGUGCUU | AAGCACUUU AUGCUCCU |
| 5167 | AAGGAGCA CUGAUGU X GAA AAAGUGCU | AGCACUUUA UGCUCCUU |
| 5172 | GUGCCAAG CUGAUGU X GAA AGCAUAAA | UUUAUGCUC CUUGGCAC |
| 5175 | GCUGUGCC CUGAUGU X GAA AGGAGCAU | AUGCUCCUU GGCACAGC |
| 5195 | GCAUAAAU CUGAUGU X GAA ACACAUCA | UGAUGUGUA AUUUAUGC |
| 5198 | CUUGCAUA CUGAUGU X GAA AUUACACA | UGUGUAAUU UAUGCAAG |
| 5199 | GCUUGCAU CUGAUGU X GAA AAUUACAC | GUGUAAUUU AUGCUUGC |
| 5200 | AGCUUGCA CUGAUGU X GAA AAAUUACA | UGUAAUUUA UGCAAGCU |
| 5209 | UGGAGAGG CUGAUGU X GAA AGCUUGCA | UGCAAGCUC CUCUCCA |
| 5213 | UAGCUGGA CUGAUGU X GAA AGGGAGCU | AGCUCCCUC UCCAGCUA |
| 5215 | CCUAGCUG CUGAUGU X GAA AGAGGGAG | CUCCCUCUC CAGCUAGG |
| 5221 | CUGAGUCC CUGAUGU X GAA AGCUGGAG | CUCCAGCUA GGACUCAG |
| 5227 | AAUAUCCU CUGAUGU X GAA AGUCCUAG | CUAGGACUC AGGAUAUU |

Table VIII-continued

Mouse flt-1 VEGF Receptor-Hammerhead Ribozyme and Substrate Sequence

| nt. Position | HH Ribozyme | Substrate |
|---|---|---|
| 5233 | UUGACUAA CUGAUGU X GAA AUCCUGAG | CUCAGGAUA UUAGUCAA |
| 5235 | CAUUGACU CUGAUGU X GAA AUAUCCUG | CAGGAUAUU AGUCAAUG |
| 5236 | UCAUUGAC CUGAUGU X GAA AAUAUCCU | AGGAUAUUA GUCAAUGA |
| 5239 | GGCUCAUU CUGAUGU X GAA ACUAAUAU | AUAUUAGUC AAUGAGCC |
| 5250 | UUCCUUUU CUGAUGU X GAA AUGGCUCA | UGAGCCAUC AAAAGGAA |
| 5273 | AAAUAAGA CUGAUGU X GAA AGGUUUUU | AAAAACCUA UCUUAUUU |
| 5275 | GAAAAUAA CUGAUGU X GAA AUAGGUUU | AAACCUAUC UUAUUUUC |
| 5277 | AUGAAAAU CUGAUGU X GAA AGAUAGGU | ACCUAUCUU AUUUUCAU |
| 5278 | GAUGAAAA CUGAUGU X GAA AAGAUAGG | CCUAUCUUA UUUUCAUC |
| 5280 | CAGAUGAA CUGAUGU X GAA AUAAGAUA | UAUCUUAUU UUCAUCUG |
| 5281 | ACAGAUGA CUGAUGU X GAA AAUAAGAU | AUCUUAUUU UCAUCUGU |
| 5282 | AACAGAUG CUGAUGU X GAA AAAUAAGA | UCUUAUUUU CAUCUGUU |
| 5283 | AAACAGAU CUGAUGU X GAA AAAAUAAG | CUUAUUUUC AUCUGUUU |
| 5286 | AUGAAACA CUGAUGU X GAA AUGAAAAU | AUUUUCAUC UGUUUCAU |
| 5290 | AGGUAUGA CUGAUGU X GAA ACAGAUGA | UCAUCUGUU UCAUACCU |
| 5291 | AAGGUAUG CUGAUGU X GAA AACAGAUG | CAUCUGUUU CAUACCUU |
| 5292 | CAAGGUAU CUGAUGU X GAA AAACAGAU | AUCUGUUUC AUACCUUG |
| 5295 | AGACAAGG CUGAUGU X GAA AUGAAACA | UGUUUCAUA CCUUGUCU |
| 5299 | CCCCAGAC CUGAUGU X GAA AGGUAUGA | UCAUACCUU GUCUGGGG |
| 5302 | AGACCCCA CUGAUGU X GAA ACAAGGUA | UACCUUGUC UGGGGUCU |
| 5309 | CGUCAUUA CUGAUGU X GAA ACCCCAGA | UCUGGGGUC UAAUGACG |
| 5311 | AUCGUCAU CUGAUGU X GAA AGACCCCA | UGGGGUCUA AUGACGAU |
| 5331 | CCCAUGUC CUGAUGU X GAA ACCCUGUU | AACAGGGUA GACAUGGG |
| 5350 | CCCUUUUC CUGAUGU X GAA ACCCUGUC | GACAGGGUA GAAAAGGG |
| 5367 | ACCCCAAA CUGAUGU X GAA AGCGGGCA | UGCCCGCUC UUUGGGGU |
| 5369 | AGACCCCA CUGAUGU X GAA AGAGCGGG | CCCGCUCUU UGGGGUCU |
| 5370 | UAGACCCC CUGAUGU X GAA AAGAGCGG | CCGCUCUUU GGGGUCUA |
| 5376 | CAUCUCUA CUGAUGU X GAA ACCCCAAA | UUUGGGGUC UAGAGAUG |
| 5378 | CUCAUCUC CUGAUGU X GAA AGACCCCA | UGGGGUCUA GAGAUGAG |
| 5395 | AUUUUAGA CUGAUGU X GAA ACCCAGGG | CCCUGGGUC UCUAAAAU |
| 5397 | CCAUUUUA CUGAUGU X GAA AGACCCAG | CUGGGUCUC UAAAAUGG |
| 5399 | AGCCAUUU CUGAUGU X GAA AGAGACCC | GGGUCUCUA AAAUGGCU |
| 5408 | UUCUAAGA CUGAUGU X GAA AGCCAUUU | AAAUGGCUC UCUUAGAA |
| 5410 | ACUUCUAA CUGAUGU X GAA AGAGCCAU | AUGGCUCUC UUAGAAGU |
| 5412 | CAACUUCU CUGAUGU X GAA AGAGAGCC | GGCUCUCUU AGAAGUUG |
| 5413 | ACAACUUC CUGAUGU X GAA AAGUGUGC | GCUCUCUUA GAAGUUGU |
| 5419 | GCACAUAC CUGAUGU X GAA ACUUCUAA | UUAGAAGUU GUAUGUGC |

Table VIII-continued

Mouse flt-1 VEGF Receptor-Hammerhead Ribozyme and Substrate Sequence

| nt. Position | HH Ribozyme | Substrate |
|---|---|---|
| 5422 | UUUGCACA CUGAUGU X GAA ACAACUUC | GAAGUUGUA UGUGCAAA |
| 5432 | CAGACCAU CUGAUGU X GAA AUUUGCAC | GUGCAAAUU AUGGUCUG |
| 5433 | ACAGACCA CUGAUGU X GAA AAUUUGCA | UGCAAAUUA UGGUCUGU |
| 5438 | AGCACACA CUGAUGU X GAA ACCAUAAU | AUUAUGGUC UGUGUGCU |
| 5447 | CACGACCU CUGAUGU X GAA AGCACACA | UGUGUGCUU AGGUCGUG |
| 5448 | GCACGACC CUGAUGU X GAA AAGCACAC | GUGUGCUUA GGUCGUGC |
| 5452 | GUGUGCAC CUGAUGU X GAA ACCUAAGC | GCUUAGGUC GUGCACAC |
| 5475 | CCAGCUGU CUGAUGU X GAA ACCGGCUC | GAGCCGGUC ACAGCUGG |
| 5497 | AAAGCAGC CUGAUGU X GAA AUUCAUCG | CGAUGAAUA GCUGCUUU |
| 5504 | CUCUCCCA CUGAUGU X GAA AGCAGCUA | UAGCUGCUU UGGGAGAG |
| 5505 | GCUCUCCC CUGAUGU X GAA AAGCAGCU | AGCUGCUUU GGGAGAGC |
| 5524 | UAAGUGGC CUGAUGU X GAA AGCAUGCU | AGCAUGCUA GCCACUUA |
| 5531 | AGAGAAUU CUGAUGU X GAA AGUGGCUA | UAGCCACUU AAUUCUCU |
| 5532 | CAGAGAAU CUGAUGU X GAA AAGUGGCU | AGCCACUUA AUUCUCUG |
| 5535 | GCUCAGAG CUGAUGU X GAA AUUAAGUG | CACUUAAUU CUCUGACC |
| 5536 | CGGUCAGA CUGAUGU X GAA AAUUAAGU | ACUUAAUUC UCUGACCG |
| 5538 | CCCGGUCA CUGAUGU X GAA AGAAUUAA | UUAAUUCUC UGACCGGG |
| 5554 | GUACCCAU CUGAUGU X GAA AUGCUGGC | GCCAGCAUC AUGGGUAC |
| 5561 | GGAGCAGG CUGAUGU X GAA ACCCAUGA | UCAUGGGUA CCUGCUCC |
| 5568 | ACACAGGG CUGAUGU X GAA AGCAGGUA | UACCUGCUC CCCUGUGU |
| 5577 | GGAUGGGG CUGAUGU X GAA ACACAGGG | CCCUGUGUA CCCCAUCC |
| 5584 | ACCUUAAG CUGAUGU X GAA AUGGGGUA | UACCCCAUC CUUAAGGU |
| 5587 | AAAACCUU CUGAUGU X GAA AGGAUGGG | CCCAUCCUU AAGGUUUU |
| 5588 | GAAAACCU CUGAUGU X GAA AAGGAUGG | CCAUCCUUA AGGUUUUC |
| 5593 | AGACAGAA CUGAUGU X GAA ACCUUAAG | CUUAAGGUU UUCUGUCU |
| 5594 | CAGACAGA CUGAUGU X GAA AACCUUAA | UUAAGGUUU UCUGUCUG |
| 5595 | UCAGACAG CUGAUGU X GAA AAACCUUA | UAAGGUUUU CUGUCUGA |
| 5596 | AUCAGACA CUGAUGU X GAA AAAACCUU | AAGGUUUUC UGUCUGAU |
| 5600 | UCUCAUCA CUGAUGU X GAA ACAGAAAA | UUUUCUGUC UGAUGAGA |
| 5627 | UCAGUGGG CUGAUGU X GAA AUUGCACU | AGUGCAAUC CCACUGA |
| 5660 | UGCACCAA CUGAUGU X GAA AGCCACAG | CUGUGGCUC UUGGUGCA |
| 5662 | AGUGCACC CUGAUGU X GAA AGAGCCAC | GUGGCUCUU GGUGCACU |
| 5671 | UGGCUGGU CUGAUGU X GAA AGUGCACC | GGUGCACUC ACCAGCCA |
| 5685 | UACUUGUC CUGAUGU X GAA AGUCCUGG | CCAGGACUA GACAAGUA |
| 5693 | CCCUUUCC CUGAUGU X GAA ACUUGUCU | AGACAAGUA GGAAAGGG |
| 5704 | GUGGCUAG CUGAUGU X GAA AGCCCUUU | AAAGGGCUU CUAGCCAC |

Table VIII-continued

Mouse flt-1 VEGF Receptor-Hammerhead Ribozyme and Substrate Sequence

| nt. Position | HH Ribozyme | Substrate |
|---|---|---|
| 5705 | UGUGGCUA CUGAUGU X GAA AAGCCCUU | AAGGGCUUC UAGCCACA |
| 5707 | AGUGUGGC CUGAUGU X GAA AGAAGCCC | GGGCUUCUA GCCACACU |
| 5731 | CCCUACCU CUGAUGU X GAA AUUUUCUU | AAGAAAAUC AGGUAGGG |
| 5736 | GCCAGCCC CUGAUGU X GAA ACCUGAUU | AAUCAGGUA GGGCUGGC |
| 5754 | UGGACAAA CUGAUGU X GAA AUGUCUUU | AAAGACAUC UUUGUCCA |
| 5756 | AAUGGACA CUGAUGU X GAA AGAUGUCU | AGACAUCUU UGUCCAUU |
| 5757 | GAAUGGAC CUGAUGU X GAA AAGAUGUC | GACAUCUUU GUCCAUUC |
| 5760 | UGCGAAUG CUGAUGU X GAA ACAAAGAU | AUCUUUGUC CAUUCGCA |
| 5764 | CUUUUGCG CUGAUGU X GAA AUGGACAA | UUGUCCAUU CGCAAAAG |
| 5765 | GCUUUUGC CUGAUGU X GAA AAUGGACA | UGUCCAUUC GCAAAAGC |
| 5775 | GCCGACAA CUGAUGU X GAA AGCUUUUG | CAAAAGCUC UUGUCGGC |
| 5777 | CAGCCGAC CUGAUGU X GAA AGAGCUUU | AAAGCUCUU GUCGGCUG |
| 5780 | CUGCAGCC CUGAUGU X GAA ACAAGAGC | GCUGUUGUC GGCUGCAG |
| 5794 | GCCUGACU CUGAUGU X GAA ACACACUG | CAGUGUGUA AGUCAGGC |
| 5798 | CAUCGCCU CUGAUGU X GAA ACUUACAC | GUGUAAGUC AGGCGAUG |
| 5818 | UUCUCUGG CUGAUGU X GAA AGCCUGUC | CAGAGGCUA CCAGAGAA |
| 5852 | GGAUGAGA CUGAUGU X GAA ACCUCAGG | CCUGAGGUU UCUCAUCC |
| 5853 | UGGAUGAG CUGAUGU X GAA AACCUCAG | CUGAGGUUU CUCAUCCA |
| 5854 | CUGGAUGA CUGAUGU X GAA AAACCUCA | UGAGGUUUC UCAUCCAG |
| 5856 | AUCUGGAU CUGAUGU X GAA AGAAACCU | AGGUUUCUC AUCCAGAU |
| 5859 | GAUAUCUG CUGAUGU X GAA AUGAGAAA | UUUCUCAUC CAGAUAUC |
| 5865 | UUGCUGGA CUGAUGU X GAA AUCUGGAU | AUCCAGAUA UCCAGCAA |
| 5867 | AAUUGCUG CUGAUGU X GAA AUAUCUGG | CCAGAUAUC CAGCAAUU |
| 5875 | CACCCCCC CUGAUGU X GAA AUUGCUGG | CCAGCAAUU GGGGGGUG |
| 5896 | GGACCAUC CUGAUGU X GAA AUGGUCUU | AAGACCAUA GAUGGUCC |
| 5903 | UAAUACAG CUGAUGU X GAA ACCAUCUA | UAGAUGGUC CUGUAUUA |
| 5908 | AGGAAUAA CUGAUGU X GAA ACAGGACC | GGUCCUGUA UUAUUCCG |
| 5910 | AUCGGAAU CUGAUGU X GAA AUACAGGA | UCCUGUAUU AUUCCGAU |
| 5911 | AAUCGGAA CUGAUGU X GAA AAUACAGG | CCUGUAUUA UUCCGAUU |
| 5913 | AAAAUCGG CUGAUGU X GAA AUAAUACA | UGUAUUAUU CCGAUUUU |
| 5914 | UAAAAUCG CUGAUGU X GAA AAUAAUAC | GUAUUAUUC CGAUUUUA |
| 5919 | AUUAUUAA CUGAUGU X GAA AUCGGAAU | AUUCCGAUU UUAAUAAU |
| 5920 | GAUUAUUA CUGAUGU X GAA AAUCGGAA | UUCCGAUUU UAAUAAUC |
| 5921 | AGAUUAUU CUGAUGU X GAA AAAUCGGA | UCCGAUUUU AAUAAUCU |
| 5922 | UAGAUUAU CUGAUGU X GAA AAAAUCGG | CCGAUUUUA AUAAUCUA |
| 5925 | AAUUAGAU CUGAUGU X GAA AUUAAAAU | AUUUUAAUA AUCUAAUU |
| 5928 | ACGAAUUA CUGAUGU X GAA AUUAUUAA | UUAAUAAUC UAAUUCGU |

Table VIII-continued

Mouse flt-1 VEGF Receptor-Hammerhead Ribozyme and Substrate Sequence

| nt. Position | HH Ribozyme | Substrate |
|---|---|---|
| 5930 | UCACGAAU CUGAUGU X GAA AGAUUAUU | AAUAAUCUA AUUCGUGA |
| 5933 | UGAUCACG CUGAUGU X GAA AUUAGAUU | AAUCUAAUU CGUGAUCA |
| 5934 | AUGAUCAC CUGAUGU X GAA AAUUAGAU | AUCUAAUUC GUGAUCAU |
| 5940 | CUCUUAAU CUGAUGU X GAA AUCACGAA | UUCGUGAUC AUUAAGAG |
| 5943 | AGUCUCUU CUGAUGU X GAA AUGAUCAC | GUGAUCAUU AAGAGACU |
| 5944 | AAGUCUCU CUGAUGU X GAA AAUGAUCA | UGAUCAUUA AGAGACUU |
| 5952 | AUUUACUA CUGAUGU X GAA AGUCUCUU | AAGAGACUU UAGUAAAU |
| 5953 | CAUUUACU CUGAUGU X GAA AAGUCUCU | AGAGACUUU AGUAAAUG |
| 5954 | ACAUUUAC CUGAUGU X GAA AAAGUCUC | GAGACUUUA GUAAAUGU |
| 5957 | GGGACAUU CUGAUGU X GAA ACUAAAGU | ACUUUAGUA AAUGUCCC |
| 5963 | GGAAAAGG CUGAUGU X GAA ACAUUUAC | GUAAAUGUC CCUUUUCC |
| 5967 | UGUGGGAA CUGAUGU X GAA AGGGACAU | AUGUCCCUU UUCCCACA |
| 5968 | UUGUGGGA CUGAUGU X GAA AAGGGACA | UGUCCCUUU UCCCACAA |
| 5969 | UUUGUGGG CUGAUGU X GAA AAAGGGAC | GUCCCUUUU CCCACAAA |
| 5970 | UUUUGUGG CUGAUGU X GAA AAAAGGGA | UCCCUUUUC CCACAAAA |
| 5981 | CUUUUCUU CUGAUGU X GAA ACUUUUGU | ACAAAAGUA AAGAAAAG |
| 5992 | AAUCCCGA CUGAUGU X GAA AGCUUUUC | GAAAAGCUA UCGGGAUU |
| 5994 | AGAAUCCC CUGAUGU X GAA AUAGCUUU | AAAGCUAUC GGGAUUCU |
| 6000 | AACCAGAG CUGAUGU X GAA AUCCCGAU | AUCGGGAUU CUCUGGUU |
| 6001 | GAACCAGA CUGAUGU X GAA AAUCCCGA | UCGGGAUUC UCUGGUUC |
| 6003 | CAGAACCA CUGAUGU X GAA AGAAUCCC | GGGAUUCUC UGGUUCUG |
| 6008 | UUAAGCAG CUGAUGU X GAA ACCAGAGA | UCUCUGGUU CUGCUUAA |
| 6009 | UUUAAGCA CUGAUGU X GAA AACCAGAG | CUCUGGUUC UGCUUAAA |
| 6014 | AAGUCUUU CUGAUGU X GAA AGCAGAAC | GUUCUGCUU AAAGACUU |
| 6015 | UAAGUCUU CUGAUGU X GAA AAGCAGAA | UUCUGCUUA AAGACUUA |
| 6022 | CCAAAGCU CUGAUGU X GAA AGUCUUUA | UAAAGACUU AGCUUUGG |
| 6023 | UCCAAAGC CUGAUGU X GAA AAGUCUUU | AAAGACUUA GCUUUGGA |
| 6027 | AGGCUCCA CUGAUGU X GAA AGCUAAGU | ACUUAGCUU UGGAGCCU |
| 6028 | UAGGCUCC CUGAUGU X GAA AAGCUAAG | CUUAGCUUU GGAGCCUA |
| 6036 | AACUUUCA CUGAUGU X GAA AGGCUCCA | UGGAGCCUA UGAAAGUU |
| 6044 | GGCUGAUC CUGAUGU X GAA ACUUUCAU | AUGAAAGUU GAUCAGCC |

Where "X" represents stem II region of a HH ribozyme (Hertel et al., 1992 Nucleic Acids Res. 20 3252). The length of stem II may be ≥ 2 base-pairs.

TABLE IX

Mouse flt1 VEGF Receptor-Hairpin Ribozyme and Substrate Sequence

| nt. Position | HP Ribozyme | Substrate |
|---|---|---|
| 33 | GUCCCAGC AGAA GACCAU ACCAGAGAAACACACGUUGUGGUACAUUACCUGGUA | AUGGUCA GCU GCUGGGAC |
| 36 | GGUGUCCC AGAA CCUGAC ACCAGAGAAACACACGUUGUGGUACAUUACCUGGUA | GUCAGCU GCU GGGACACC |
| 50 | UAAGGCAA AGAA GCGGUG ACCAGAGAAACACACGUUGUGGUACAUUACCUGGUA | CACCGCG GUC UUGCCUUA |
| 67 | GACACCCG AGAA GCGCGU ACCAGAGAAACACACGUUGUGGUACAUUACCUGGUA | ACGCGCU GCU CGGGUGUC |
| 79 | CUGUGAGA AGAA GACACC ACCAGAGAAACACACGUUGUGGUACAUUACCUGGUA | GGUCUCU GCU UCUCACAG |
| 166 | GAAAGAGA AGAA GGCCUG ACCAGAGAAACACACGUUGUGGUACAUUACCUGGUA | CAGGCCA GAC UCUCUUUC |
| 197 | CAUGAGUG AGAA GCCUCC ACCAGAGAAACACACGUUGUGGUACAUUACCUGGUA | GGAGGCA GCC CACUCAUG |
| 214 | CGGUCGUG AGAA GAGACC ACCAGAGAAACACACGUUGUGGUACAUUACCUGGUA | GGUCUCU GCC CACGACCG |
| 266 | CUCCCACA AGAA GAUGGG ACCAGAGAAACACACGUUGUGGUACAUUACCUGGUA | CCCAUCG GCC UGUGGGAG |
| 487 | GGAUGAUG AGAA GUCUUC ACCAGAGAAACACACGUUGUGGUACAUUACCUGGUA | GAAGACA GCU CAUCAUCC |
| 501 | CGUCACCC AGAA GGGGAU ACCAGAGAAACACACGUUGUGGUACAUUACCUGGUA | AUCCCCU GCC GGGUGACG |
| 566 | CUUUGCCC AGAA GGGGUA ACCAGAGAAACACACGUUGUGGUACAUUACCUGGUA | UACCCCU GAU GGGCAAAG |
| 640 | CGCAGUUC AGAA GUCCUA ACCAGAGAAACACACGUUGUGGUACAUUACCUGGUA | UAGGACU GCU GAACUGCG |
| 691 | GCCGAUGG AGAA GAUAGU ACCAGAGAAACACACGUUGUGGUACAUUACCUGGUA | ACUAUCU GAC CCAUCGGC |
| 703 | UUGUAUUG AGAA GCCGAU ACCAGAGAAACACACGUUGUGGUACAUUACCUGGUA | AUCGGCA GAC CAAUACAA |
| 736 | CUGGGCUC AGAA GGCGUA ACCAGAGAAACACACGUUGUGGUACAUUACCUGGUA | UACGCCC GCC GAGCCCAG |
| 754 | GCCCGUGG AGAA GUCUCA ACCAGAGAAACACACGUUGUGGUACAUUACCUGGUA | UGAGACU GCU CCACGGGC |
| 766 | GGACAAGA AGAA GCCCGU ACCAGAGAAACACACGUUGUGGUACAUUACCUGGUA | ACGGGCA GAC UCUUGUCC |
| 871 | UCCGGUCA AGAA GCUGCC ACCAGAGAAACACACGUUGUGGUACAUUACCUGGUA | GGCAGCG GAU UGACCGGA |
| 960 | CUUCACGC AGAA GGUGUA ACCAGAGAAACACACGUUGUGGUACAUUACCUGGUA | UACACCU GUC GCGUGAAG |
| 988 | UGUUGAAA AGAA GGAACG ACCAGAGAAACACACGUUGUGGUACAUUACCUGGUA | CGUUCCA GUC UUUCAACA |
| 1051 | CCUGCACC AGAA GCUUCC ACCAGAGAAACACACGUUGUGGUACAUUACCUGGUA | GGAAGCA GCC GGUGCAGG |
| 1081 | GCCGAUAG AGAA GUCUUC ACCAGAGAAACACACGUUGUGGUACAUUACCUGGUA | GAAGACG GUC CUAUCGGC |
| 1090 | UCAUGGAC AGAA GAUAGG ACCAGAGAAACACACGUUGUGGUACAUUACCUGGUA | CCUAUCG GCU GUCCAUGA |
| 1093 | CUUUCAUG AGAA GCCGAU ACCAGAGAAACACACGUUGUGGUACAUUACCUGGUA | AUCGGCU GUC CAUGAAAG |
| 1169 | AAAUAGCG AGAA GACUUC ACCAGAGAAACACACGUUGUGGUACAUUACCUGGUA | GAAGUCU GCU CGCUAUUU |
| 1315 | UUUCGUAG AGAA GAGGUU ACCAGAGAAACACACGUUGUGGUACAUUACCUGGUA | AACCUCA GAU CUACGAAA |
| 1363 | UGCUGCCC AGAA GAUAGA ACCAGAGAAACACACGUUGUGGUACAUUACCUGGUA | UCUAUCC GCU GGGCAGCA |
| 1604 | GUCUGAGA AGAA GCCACC ACCAGAGAAACACACGUUGUGGUACAUUACCUGGUA | GGUGGCU GAC UCUCAGAC |
| 1612 | UUCCAGGG AGAA GAGAGU ACCAGAGAAACACACGUUGUGGUACAUUACCUGGUA | ACUCUCA GAC CCCUGGAA |
| 1629 | GGCCCGGC AGAA GUAGAU ACCAGAGAAACACACGUUGUGGUACAUUACCUGGUA | AUCUACA GCU GCCGGGCC |
| 1632 | GAAGGCCC AGAA GCUGUA ACCAGAGAAACACACGUUGUGGUACAUUACCUGGUA | UACAGCU GCC GGGCCUUC |
| 1688 | UUCGGCAC AGAA GUGACA ACCAGAGAAACACACGUUGUGGUACAUUACCUGGUA | UGUCACA GAU GUGCCGAA |
| 1730 | UCUCCUUC AGAA GGCAUC ACCAGAGAAACACACGUUGUGGUACAUUACCUGGUA | GAUGCCA GCC GAAGGAGA |
| 1753 | CCACACAG AGAA GUUUCA ACCAGAGAAACACACGUUGUGGUACAUUACCUGGUA | UGAAACU GUC CUGUGUGG |
| 2017 | GGuUUUGA AGAA GGUGUG ACCAGAGAAACACACGUUGUGGUACAUUACCUGGUA | CACACCU GCU UCAAAACC |
| 2101 | ACCAAGUG AGAA GAGGCG ACCAGAGAAACACACGUUGUGGUACAUUACCUGGUA | CGCCUCA GAU CACUUGGU |

TABLE IX-continued

Mouse flt1 VEGF Receptor-Hairpin Ribozyme and Substrate Sequence

| nt. Position | HP Ribozyme | Substrate |
|---|---|---|
| 2176 | UUUCAAUA AGAA GCGUGC ACCAGAGAAACACACGUUGUGGUACAUUACCUGGUA | GCACGCU GUU UAUUGAAA |
| 2258 | GUGAGGUA AGAA GCGCUU ACCAGAGAAACACACGUUGUGGUACAUUACCUGGUA | AAGCGCA GCC UACCUCAC |
| 2305 | UGAGCGUG AGAA GCUCCA ACCAGAGAAACACACGUUGUGGUACAUUACCUGGUA | UGGAGCU GAU CACGCUCA |
| 2383 | CGGAAGAA AGAA GCUUCA ACCAGAGAAACACACGUUGUGGUACAUUACCUGGUA | UGAAGCG GUC UUCUUCCG |
| 2405 | GACAGGUA AGAA GUCUUU ACCAGAGAAACACACGUUGUGGUACAUUACCUGGUA | AAAGACA GAC UACCUGUC |
| 2432 | GGAACUUC AGAA GGGUCC ACCAGAGAAACACACGUUGUGGUACAUUACCUGGUA | GGACCCA GAU GAAGUUCC |
| 2464 | CAUAGGGC AGAA GUUCAC ACCAGAGAAACACACGUUGUGGUACAUUACCUGGUA | GUGAACG GCU GCCCUAUG |
| 2467 | CAUCAUAG AGAA GCCGUU ACCAGAGAAACACACCUUGUGGUACAUUACCUGGUA | AACGGCU GCC CUAUGAUG |
| 2592 | CACAGUCC AGAA GGUGGG ACCAGAGAAACACACGUUGUGGUACAUUACCUGGUA | CCCACCU GCC GGACUGUG |
| 2596 | CAGCCACA AGAA GGCAGG ACCAGAGAAACACACGUUGUGGUACAUUACCUGGUA | CCUGCCG GAC UGUGGGUG |
| 2653 | GUUCGGUC AGAA GAGCUU ACCAGAGAAACACACGUUGUGGUACAUUACCUGGUA | AAGCUCU GAU GACCGAAC |
| 2743 | CGAUCACC AGAA GAGGCC ACCAGAGAAACACACGUUGUGGUACAUUACCUGGUA | GGCCUCU GAU GGUGAUCG |
| 2779 | GGUAGUUG AGAA GGUUUC ACCAGAGAAACACACGUUGUGGUACAUUACCUGGUA | GAAACCU GUC CAACUACC |
| 2814 | CUUGUUGA AGAA GAAUAA ACCAGAGAAACACACGUUGUGGUACAUUACCUGGUA | UUAUUCU GUC UCAACAAG |
| 2831 | AUAUGCAA AGAA GCGUCC ACCAGAGAAACACACGUUGUGGUACAUUACCUGGUA | GGACGCA GCC UUGCAUAU |
| 2895 | ACUGUCUA AGAA GGGCUU ACCAGAGAAACACACGUUGUGGUACAUUACCUGGUA | AAGCCCC GCC UAGACAGU |
| 2913 | GACACUUG AGAA GCUGAC ACCAGAGAAACACACGUUGUGGUACAUUACCUGGUA | GUCAGCA GCU CAAGUGUC |
| 2928 | GAAGCUGG AGAA GGUGAC ACCAGAGAAACACACGUUGUGGUACAUUACCUGGUA | GUCACCA GCU CCAGCUUC |
| 2934 | UUCAGGGA AGAA GGAGCU ACCAGAGAAACACACGUUGUGGUACAUUACCUGGUA | AGCUCCA GCU UCCCUGAA |
| 3001 | UGGUGAGG AGAA GCUUGG ACCAGAGAAACACACGUUGUGGUACAUUACCUGGUA | CCAAGCA GCC CCUCACCA |
| 3022 | UGUAGGAA AGAA GGUCUU ACCAGAGAAACACACGUUGUGGUACAUUACCUGGUA | AAGACCU GAU UUCCUACA |
| 3033 | CACUUGGA AGAA GUAGGA ACCAGAGAAACACACGUUGUGGUACAUUACCUGGUA | UCCUACA GUU UCCAAGUG |
| 3064 | UUCUGGAG AGAA GAAACU ACCAGAGAAACACACGUUGUGGUACAUUACCUGGUA | AGUUUCU GUC CUCCAGAA |
| 3179 | CUCACAUA AGAA GGGUUC ACCAGAGAAACACACGUUGUGGUACAUUACCUGGUA | GAACCCU GAU UAUGUGAG |
| 3357 | CUUCAGGC AGAA GCAGAA ACCAGAGAAACACACGUUGUGGUACAUUACCUGGUA | UUCUGCA GCC GCCUGAAG |
| 3360 | UUCCUUCA AGAA GCUGCA ACCAGAGAAACACACGUUGUGGUACAUUACCUGGUA | UGCAGCC GCC UGAAGGAA |
| 3379 | GGGUUCUC AGAA GCAUGC ACCAGAGAAACACACGUUGUGGUACAUUACCUGGUA | GCAUGCG GAU GAGAACCC |
| 3463 | GUUCAGCA AGAA GGGGCC ACCAGAGAAACACACGUUGUGGUACAUUACCUGGUA | GGCCCCG GUU UGCUGAAC |
| 3496 | UGGCUUGA AGAA GGUCAC ACCAGAGAAACACACGUUGUGGUACAUUACCUGGUA | GUGACCU GCU UCAAGCCA |
| 3553 | UGUUUCUA AGAA GUAUGG ACCAGAGAAACACACGUUGUGGUACAUUACCUGGUA | CCAUACU GAC UAGAAACA |
| 3615 | AUCUGCAA AGAA GUCCUU ACCAGAGAAACACACGUUGUGGUACAUUACCUGGUA | AAGGACG GCU UUGCAGAU |
| 3623 | AAAUGUGG AGAA GCAAAG ACCAGAGAAACACACGUUGUGGUACAUUACCUGGUA | CUUUGCA GAU CCACAUUU |
| 3650 | CUCACAUC AGAA GAGCUU ACCAGAGAAACACACGUUGUGGUACAUUACCUGGUA | AAGCUCU GAU GAUGUGAG |
| 3754 | UAGUGUCC AGAA GAUAGU ACCAGAGAAACACACGUUGUGGUACAUUACCUGGUA | ACUAUCA GCU GGACACUA |
| 3772 | GGGAGCCC AGAA GAGUGC ACCAGAGAAACACACGUUGUGGUACAUUACCUGGUA | GCACUCU GCU GGGCUCCC |
| 3796 | UCCAGGUG AGAA GCUUCA ACCAGAGAAACACACGUUGUGGUACAUUACCUGGUA | UGAAGCG GUU CACCUGGA |
| 3881 | CUCGGCAG AGAA GAAAGU ACCAGAGAAACACACGUUGUGGUACAUUACCUGGUA | ACUUUCC GAU CUGCCGAG |

TABLE IX-continued

Mouse flt1 VEGF Receptor-Hairpin Ribozyme and Substrate Sequence

| nt. Position | HP Ribozyme | Substrate |
|---|---|---|
| 3886 | UGGGCCUC AGAA GAUCGG ACCAGAGAAACACACGUUGUGGUACAUUACCUGGUA | CCGAUCU GCC GAGGCCCA |
| 3897 | GAAGCAGA AGAA GGGCCU ACCAGAGAAACACACGUUGUGGUACAUUACCUGGUA | AGGCCCA GCU UCUGCUUC |
| 3903 | GCUGGAGA AGAA GAAGCU ACCAGAGAAACACACGUUGUGGUACAUUACCUGGUA | AGCUUCU GCU UCUCCAGC |
| 3912 | GUGGCCAC AGAA GGAGAA ACCAGAGAAACACACGUUGUGGUACAUUACCUGGUA | UUCUCCA GCU GUGGCCAC |
| 3969 | UGGAGAAC AGAA GGACUC ACCAGAGAAACACACGUUGUGGUACAUUACCUGGUA | GAGUCCU GCC GUUCUCCA |
| 3972 | GGGUGGAG AGAA GCAGGA ACCAGAGAAACACACGUUGUGGUACAUUACCUGGUA | UCCUGCU GUU CUCCACCC |
| 3986 | GAGUUGUA AGAA GGGGGU ACCAGAGAAACACACGUUGUGGUACAUUACCUGGUA | ACCCCCA GAC UACAACUC |
| 4018 | UUUAGGCG AGAA GGGAGG ACCAGAGAAACACACGUUGUGGUACAUUACCUGGUA | CCUCCCC GCC CGCCUAAA |
| 4022 | AAGCUUUA AGAA GGCGGG ACCAGAGAAACACACGUUGUGGUACAUUACCUGGUA | CCCGCCC GCC UAAAGCCU |
| 4040 | GUUGUCGG AGAA GGUGAG ACCAGAGAAACACACGUUGUGGUACAUUACCUGGUA | CUCACCA GCC CCGACAAC |
| 4053 | CUGUCAGG AGAA GGUUGU ACCAGAGAAACACACGUUGUGGUACAUUACCUGGUA | ACAACCA GCC CCUGACAG |
| 4095 | UCCUGUGG AGAA GAAUAG ACCAGAGAAACACACGUUGUGGUACAUUACCUGGUA | CUAUUCC GCU CCACAGGA |
| 4110 | CGAAAGC AGAA GGCUCC ACCAGAGAAACACACGUUGUGGUACAUUACCUGGUA | GGAGCCA GCU GCUUUUCG |
| 4113 | UCACGAAA AGAA GCUGGC ACCAGAGAAACACACGUUGUGGUACAUUACCUGGUA | GCCAGCU GGU UUUCGUGA |
| 4168 | UUAGUCAA AGAA GCAACA ACCAGAGAAACACACGUUGUGGUACAUUACCUGGUA | UGUUGCU GUU UUGACUAA |
| 4290 | GGUGGCG AGAA GUCGCC ACCAGAGAAACACACGUUGUGGUACAUUACCUGGUA | CGCGACC GCC CGCCCACC |
| 4294 | GGCCGGUG AGAA GGCGGU ACCAGAGAAACACACGUUGUGGUACAUUACCUGGUA | ACCGCCC GCC CACCGGCC |
| 4329 | AGUCCCAC AGAA GCAGGG ACCAGAGAAACACACGUUGUGGUACAUUACCUGGUA | CCCUGCA GCU GUGGGACU |
| 4378 | CAGAGCAG AGAA GUGCAU ACCAGAGAAACACACGUUGUGGUACAUUACCUGGUA | AUGCACU GAC CUGCUCUG |
| 4383 | AGAGACAG AGAA GGUCAG ACCAGAGAAACACACCUUGUGGUACAUUACCUGGUA | CUGACCU GCU CUGUCUCU |
| 4388 | AUAAGAGA AGAA GAGCAG ACCAGAGAAACACACGUUGUGGUACAUUACCUGGUA | CUGCUCU GUC UCUCUUAU |
| 4457 | CUCCACAG AGAA GACGCA ACCAGAGAAACACACGUUGUGGUACAUUACCUGGUA | UGCGUCC GUC CUGUGGAG |
| 4525 | CCCGAAAC AGAA GACGCC ACCAGAGAAACACACGUUGUGGUACAUUACCUGGUA | GGCCUCC GCU GUUUCGGG |
| 4528 | GGGCCCGA AGAA GCGGAG ACCAGAGAAACACACGUUGUGGUACAUUACCUGGUA | CUCCGCU GUU UCGGGCCC |
| 4643 | AAACAGAC AGAA GAAGAC ACCAGAGAAACACACGUUGUGGUACAUUACCUGGUA | GUCUUCU GUU GUCUGUUU |
| 4650 | GGAUGGUA AGAA GACAAC ACCAGAGAAACACACGUUGUGGUACAUUACCUGGUA | GUUGUCU GUU UACCAUCC |
| 4724 | ACUAGAGG AGAA GAUGAU ACCAGAGAAACACACGUUGUGGUACAUUACCUGGUA | AUCAUCA GUU CCUCUAGU |
| 4771 | AUGCGAAG AGAA GGCCUG ACCAGAGAAACACACGUUGUGGUACAUUACCUGGUA | CAGGCCU GAC CUUCGCAU |
| 4785 | UCCCCGUG AGAA GUAUGC ACCAGAGAAACACACGUUGUGGUACAUUACCUGGUA | GCAUACU GCU CACGGGGA |
| 4809 | CUAGGCCA AGAA GGACCA ACCAGAGAAACACACGUUGUGGUACAUUACCUGGUA | UGGUCCA GUU UGGCCUAG |
| 4834 | UUGAGCCC AGAA GUAGGC ACCAGAGAAACACACGUUGUGGUACAUUACCUGGUA | GCCUACU GAU GGGCUCAA |
| 4912 | AUAUAUAA AGAA GGAUAA ACCAGAGAAACACACGUUGUGGUACAUUACCUGGUA | UUAUCCU GUU UUAUAUAU |
| 5119 | UCCUCUCA AGAA GCCUUG ACCAGAGAAACACACGUUGUGGUACAUUACCUGGUA | CAAGGCA GUC UGAGAGGA |
| 5144 | UAAAUAUG AGAA GAUACU ACCAGAGAAACACACGUUGUGGUACAUUACCUGGUA | AGUAUCA GCC CAUAUUUA |
| 5287 | AGGUAUGA AGAA GAUGAA ACCAGAGAAACACACGUUGUGGUACAUUACCUGGUA | UUCAUCU GUU UCAUACCU |
| 5363 | CCCCAAAG AGAA GGCACC ACCAGAGAAACACACGUUGUGGUACAUUACCUGGUA | GGUGCCC GCU CUUUGGGG |
| 5462 | CCGGCUCC AGAA GGUGUG ACCAGAGAAACACACGUUGUGGUACAUUACCUGGUA | CACACCU GCC GGAGCCGG |

TABLE IX-continued

Mouse flt1 VEGF Receptor-Hairpin Ribozyme and Substrate Sequence

| nt. Position | HP Ribozyme | Substrate |
|---|---|---|
| 5478 | GUCUGCCC AGAA GUGACC ACCAGAGAAACACACGUUGUGGUACAUUACCUGGUA | GGUCACA GCU CGGCAGAC |
| 5486 | UAUUCAUC AGAA GCCCAG ACCAGAGAAACACACGUUGUGGUACAUUACCUGGUA | CUGGGCA GAC GAUGAAUA |
| 5500 | UCUCCCAA AGAA GCUAUU ACCAGAGAAACACACGUUGUGGUACAUUACCUGGUA | AAUAGCU GCU UUGGGAGA |
| 5539 | CUGGCCCG AGAA GAGAAU ACCAGAGAAACACACGUUGUGGUACAUUACCUGGUA | AUUCUCU GAC CGGGCCAG |
| 5564 | CACAGGGG AGAA GGUACC ACCAGAGAAACACACGUUGUGGUACAUUACCUGGUA | GGUACCU GCU CCCCUGUG |
| 5597 | UCUCAUCA AGAA GAAAAC ACCAGAGAAACACACGUUGUGGUACAUUACCUGGUA | GUUUUCU GUC UGAUGAGA |
| 5601 | CCAGUCUC AGAA GACAGA ACCAGAGAAACACACGUUGUGGUACAUUACCUGGUA | UCUGUCU GAU GAGACUGG |
| 5639 | GGGCUGCA AGAA GUCUCA ACCAGAGAAACACACGUUGUGGUACAUUACCUGGUA | UGAGACA GCC UGCAGCCC |
| 5646 | CCACAGUG AGAA GCAGGC ACCAGAGAAACACACGUUGUGGUACAUUACCUGGUA | GCCUGCA GCC CACUGUGG |
| 5781 | CACACUGC AGAA GACAAG ACCAGAGAAACACACGUUGUGGUACAUUACCUGGUA | CUUGUCG GCU GCAGUGUG |
| 5829 | CUGUUCUC AGAA GUUUCU ACCAGAGAAACACACGUUGUGGUACAUUACCUGGUA | AGAAACG GAU GAGAACAG |
| 5842 | AAACCUCA AGAA GCUGUU ACCAGAGAAACACACGUUGUGGUACAUUACCUGGUA | AACAGCA GCC UGAGGUUU |
| 5915 | UUAUUAAA AGAA GAAUAA ACCAGAGAAACACACGUUGUGGUACAUUACCUGGUA | UUAUCC GAU UUUAAUAA |
| 6010 | AGUCUUUA AGAA GAACCA ACCAGAGAAACACACGUUGUGGUACAUUACCUGGUA | UGGUUCU GCU UAAAGACU |

TABLE X

Homologous Hammerhead Ribozyme Target Sites Between Human flt-1 and KDR RNA

| nt. Position | flt-1 Target Sequence | nt. Position | KDR Target Sequence |
|---|---|---|---|
| 3388 | CCGGGAU A UUUAUAA | 3151 | CCGGGAU A UUUAUAA |
| 2174 | AAUGUAU A CACAGGG | 3069 | AgUGUAU c CACAGGG |
| 2990 | UGCAAAU A UGGAAAU | 2756 | UGCAAAU u UGGAAAc |
| 2693 | CUCCCUU A UGAUGCC | 2459 | CUgCCUU A UGAUGCC |
| 2981 | GUUGAAU A CUGCAAA | 2747 | GUgGAAU u CUGCAAA |
| 1359 | UAUGGUU A AAAGAUG | 2097 | UgUGGUU u AAAGAUa |
| 3390 | GGGAUAU U UAUAAGA | 3153 | GGGAUAU U UAUAAAg |
| 3391 | GGAUAUU U AUAAGAA | 3154 | GGAUAUU U AUAAAgA |
| 2925 | ACGUGGU U AACCUGC | 2691 | AuGUGGU c AACCUuC |
| 7140 | UAUUUCU A GUCAUGA | 2340 | UACUUCU u GUCAUCA |
| 1785 | CAAUAAU A GAAGGAA | 1515 | CucUAAU u GAAGGAA |
| 2731 | GAGACUU A AACUGGG | 768 | UUGACUU c AACUGGG |
| 3974 | GAUGACU A CCAGGGC | 1466 | GAgGACU u CCAGGGa |
| 6590 | UUAAUGU A GAAAGAA | 2603 | aaAAUGU u GAAAGAA |
| 6705 | GCCAUUU A UGACAAA | 3227 | aCaAUUU u UGACAgA |
| 974 | GUCAAAU U ACUUAGA | 147 | uUCAAAU U ACUUgCA |
| 1872 | AUAAAGU U GGGACUG | 1602 | ACAAAGU c GGGAgaG |
| 2333 | ACUUGGU U UAAAAAC | 1088 | AaaUGGU a UAAAAAU |
| 2775 | AAGUGGU U CAAGCAU | 1745 | AcaUGGU a CAAGCuU |
| 3533 | UUCUCCU U AGGUGGG | 3296 | UUuUCCU U AGGUGcu |
| 3534 | UCUCCUU A GGUGGGU | 3297 | UuUCCUU A GGUGcuU |
| 3625 | GUACUCU A CUCCUGA | 4054 | GagUCU c CUCCUGu |
| 1814 | AGCACCU U GGUUGUG | 1059 | AGuACCU U GGUUacc |
| 2744 | GGCAAAU C ACUUGGA | 147 | uuCAAAU u ACUUGcA |
| 2783 | CAAGCAU C AGCAUUU | 796 | gAAGCAU C AGCAUaa |
| 3613 | GAGAGCU C CUGAGUA | 2968 | GgaAGCU C CUGAagA |
| 4052 | AAGGCCU C CCUCAAG | 1923 | ucuGCCU u GCUCAAG |
| 5305 | UCUCCAU A UCAAAAC | 456 | ggUCCAU u UCAAAuC |
| 7158 | AUGUAUU U UGUAUAC | 631 | gUcUAUU a UGUAcAu |
| 1836 | CUAGAAU U UCUGGAA | 1007 | aUgGAAU c UCUGGUg |
| 2565 | CUCUCUU C UGGCUCC | 2328 | uguUCUU C UGGCUaC |
| 4250 | CUGUACU C CACCCCA | 3388 | UUaUACU a CACCagA |
| 7124 | ACAUGGU U UGGUCCU | 3778 | cagUGGU a UGGUuCU |
| 436 | AUGGUCU U UGCCUGA | 1337 | AcGGUCU a UGCCauu |
| 2234 | GCACCAU A CCUCCUG | 1344 | augCCAU u CCUCCcc |
| 2763 | GGGCUUU U GGAAAAG | 990 | uuGCUUU U GGAAguG |

TABLE X-continued

Homologous Hammerhead Ribozyme Target Sites Between Human flt-1 and KDR RNA

| nt. Position | flt-1 Target Sequence | nt. Position | KDR Target Sequence |
|---|---|---|---|
| 4229 | CCAGACU A CAACUCG | 767 | auuGACU u CAACUgG |
| 5301 | GUUUUCU C CAUAUCA | 3307 | ugcUUCU C CAUAUCc |
| 6015 | AGAAUGU A UGCCUCU | 1917 | AcuAUGU c UGCCUug |
| 6095 | AUUCCCU A GUGAGCC | 1438 | AUaCCCU u GUGAaga |
| 6236 | UGUUGUU C CUCUUCU | 76 | UagUGUU u CUCUUga |
| 5962 | GCUUCCU U UUAUCCA | 3099 | auaUCCU c UUAUCgg |
| 7629 | UAUAUAU U CUCUGCU | 3096 | gAAAUAU c CUCUuaU |

Lowercase letters are used to represent sequence variance between flt-1 and KDR RNA

TABLE XI 2.5 μmol RNA Synthesis Cycle

| Reagent | Equivalents | Amount | Wait Time* |
|---|---|---|---|
| Phosphoramidites | 6.5 | 163 μL | 2.5 |
| S-Ethyl Tetrazole | 23.8 | 238 μL | 2.5 |
| Acetic Anhydride | 100 | 233 μL | 5 sec |
| N-Methyl Imidazole | 186 | 233 μL | 5 sec |
| TCA | 83.2 | 1.73 mL | 21 sec |
| Iodine | 8.0 | 1.18 mL | 45 sec |
| Acetonitrile | NA | 6.67 mL | NA |

*Wait time does not include contact time during delivery.

Other embodiments are within the following claims.

SEQUENCE LISTING (8502 sequences)

SEQ ID NO: 1 - DNA, 21 bp; single-stranded, linear
gcagcaccttgctctccatcc

SEQ ID NO: 2 - DNA, 21 bp; single-stranded, linear
ctgccaacttcccatgcctgc

SEQ ID NO: 3 - DNA, 11 bp; single-stranded, linear
  The letter "N" stands for any base.  The letter "H" stands for C, A, or U.
nnnnuhnnnnn

SEQ ID NO: 4 - DNA, 28 bp; single-stranded, linear
  The letter "N" stands for any base.
nnnnncugangagnnnnnncgaaannnn

SEQ ID NO: 5 - DNA, 15 bp; single-stranded, linear
  The letter "N" stands for any base.  The letter "Y" stands for U or C.  The letter "H" stands for A, U, or C.
nnnnnnnynghynnn

SEQ ID NO: 6 - DNA, 47 bp; single-stranded, linear
  The letter "N" stands for any base.  The letter "H" st for A, U, or C.
nnnngaagnnnnnnnnnnnaaahannnnnnnacauuacnnnnnnnnn

SEQ ID NO: 7 - DNA, 85 bp; single-stranded, linear
uggccggcauggucccagccuccucgcuggcgccggcugggcaacauuccgaggggaccguccccucgguaauggcgaaugggac

SEQ ID NO: 8 - DNA, 176 bp; single-stranded, linear
gggaaagcuugcgaagggcgucgucgccccgagcgguaguaagcagggaacucaccuccaauuucaguacugaaauugucguagcaguugacuacuguuaugugauugguagaggcuaagugacgguauuggcguaagucaguauugcagcacagcacaagcccgcuugcgagaau

SEQ ID NO: 9 - DNA, 15 bp; single-stranded, linear
guaugguuaaaagau

SEQ ID NO: 10 - DNA, 34 bp; single-stranded, linear
aucuuuucugaugaggcgaaagccgaaaccauac

SEQ ID NO: 11 - DNA, 15 bp; single-stranded, linear
guaugguuaaaagau

SEQ ID NO: 12 - DNA, 36 bp; single-stranded, linear
aucuuuucugaugaggccgaaaggccgaaaccauac

SEQ ID NO: 13 - DNA, 13 bp; single-stranded, linear
cagacuacaacuc

SEQ ID NO: 14 - DNA, 32 bp; single-stranded, linear
gaguugcugaugaggcgaaagccgaaagucug

SEQ ID NO: 15 - DNA, 13 bp; single-stranded, linear
cagacuacaacuc

SEQ ID NO: 16 - DNA, 34 bp; single-stranded, linear
gaguugcugaugaggccgaaaggccgaaagucug

SEQ ID NO: 17 - DNA, 15 bp; single-stranded, linear
guaugguuaaaagau

SEQ ID NO: 18 - DNA, 34 bp; single-stranded, linear; identical to SEQ ID NO: 10

SEQ ID NO: 19 - DNA, 15 bp; single-stranded, linear
guaugguuaaaagau

SEQ ID NO: 20 - DNA, 34 bp; single-stranded, linear; identical to SEQ ID NO: 10

SEQ ID NO: 21 - DNA, 13 bp; single-stranded, linear
cagacuacaacuc

SEQ ID NO: 22 - DNA, 32 bp; single-stranded, linear; identical to SEQ ID NO: 14

SEQ ID NO: 23 - DNA, 13 bp; single-stranded, linear
cagacuacaacuc

SEQ ID NO: 24 - DNA, 32 bp; single-stranded, linear; identical to SEQ ID NO: 14

SEQ ID NO: 25 - DNA, 27 bp; single-stranded, linear
  The letter "N" represents the stem II region of an HH ribozyme.
gccgagagcugaugangaaaguguccg

SEQ ID NO: 26 - DNA, 27 bp; single-stranded, linear
  The letter "N" represents the stem II region of an HH ribozyme.
ggagccgacugaugangaaaggagugu

SEQ ID NO: 27 - DNA, 27 bp; single-stranded, linear
  The letter "N" represents the stem II region of an HH ribozyme.
gaggagcccugaugangaaagaggagu

SEQ ID NO: 28 - DNA, 27 bp; single-stranded, linear
  The letter "N" represents the stem II region of an HH ribozyme.
ccggggagcugaugangaaagccgaga

SEQ ID NO: 29 - DNA, 27 bp; single-stranded, linear
  The letter "N" represents the stem II region of an HH ribozyme.
cugccgggcugaugangaaaggagccg

SEQ ID NO: 30 - DNA, 27 bp; single-stranded, linear
  The letter "N" represents the stem II region of an HH ribozyme.
cccgcucccugaugangaaagccgccg

SEQ ID NO: 31 - DNA, 27 bp; single-stranded, linear
  The letter "N" represents the stem II region of an HH ribozyme.
gagccccgcugaugangaaagcccgcu

SEQ ID NO: 32 - DNA, 27 bp; single-stranded, linear
  The letter "N" represents the stem II region of an HH ribozyme.
cugcaccccugaugangaaagccccgg

SEQ ID NO: 33 - DNA, 27 bp; single-stranded, linear
  The letter "N" represents the stem II region of an HH ribozyme.
ccccgggucugaugangaaauccucgc

SEQ ID NO: 34 - DNA, 27 bp; single-stranded, linear
  The letter "N" represents the stem II region of an HH ribozyme.
uccccgggcugaugangaaaauccucg

SEQ ID NO: 35 - DNA, 27 bp; single-stranded, linear
  The letter "N" represents the stem II region of an HH ribozyme.
caggagaccugaugangaaaccacuuc

SEQ ID NO: 36 - DNA, 27 bp; single-stranded, linear
  The letter "N" represents the stem II region of an HH ribozyme.
agccaggacugaugangaaacaaccac

SEQ ID NO: 37 - DNA, 27 bp; single-stranded, linear
  The letter "N" represents the stem II region of an HH ribozyme.
ccagccagcugaugangaaagacaacc

SEQ ID NO: 38 - DNA, 27 bp; single-stranded, linear
  The letter "N" represents the stem II region of an HH ribozyme.
cgcgcccucugaugangaaagcgcccg

SEQ ID NO: 39 - DNA, 27 bp; single-stranded, linear
  The letter "N" represents the stem II region of an HH ribozyme.
ggccgccacugaugangaaaguccguc

SEQ ID NO: 40 - DNA, 27 bp; single-stranded, linear
  The letter "N" represents the stem II region of an HH ribozyme.
cggccaaccugaugangaaacccggcc

SEQ ID NO: 41 - DNA, 27 bp; single-stranded, linear
  The letter "N" represents the stem II region of an HH ribozyme.
ccccggcccugaugangaaacgacccg

SEQ ID NO: 42 - DNA, 27 bp; single-stranded, linear
  The letter "N" represents the stem II region of an HH ribozyme.
gugagcgccugaugangaaacgcggcc

SEQ ID NO: 43 - DNA, 27 bp; single-stranded, linear
  The letter "N" represents the stem II region of an HH ribozyme.
accauggucugaugangaaagcgcgac

SEQ ID NO: 44 - DNA, 27 bp; single-stranded, linear
  The letter "N" represents the stem II region of an HH ribozyme.
caguagcucugaugangaaaccauggu

SEQ ID NO: 45 - DNA, 27 bp; single-stranded, linear
  The letter "N" represents the stem II region of an HH ribozyme.
ugucccagcugaugangaaagcugacc

SEQ ID NO: 46 - DNA, 27 bp; single-stranded, linear
  The letter "N" represents the stem II region of an HH ribozyme.
cacagcagcugaugangaaaccccggu

SEQ ID NO: 47 - DNA, 27 bp; single-stranded, linear
  The letter "N" represents the stem II region of an HH ribozyme.
agacagcucugaugangaaagcagcgc

SEQ ID NO: 48 - DNA, 27 bp; single-stranded, linear
  The letter "N" represents the stem II region of an HH ribozyme.
gagaagcacugaugangaaacagcuga

SEQ ID NO: 49 - DNA, 27 bp; single-stranded, linear
  The letter "N" represents the stem II region of an HH ribozyme.
ccugugagcugaugangaaagcagaca

SEQ ID NO: 50 - DNA, 27 bp; single-stranded, linear
  The letter "N" represents the stem II region of an HH ribozyme.
uccugugacugaugangaaaagcagac

SEQ ID NO: 51 - DNA, 27 bp; single-stranded, linear
  The letter "N" represents the stem II region of an HH ribozyme.
gauccugucugaugangaaagaagcag

SEQ ID NO: 52 - DNA, 27 bp; single-stranded, linear
  The letter "N" represents the stem II region of an HH ribozyme.
cugaacuacugaugangaaauccugug

SEQ ID NO: 53 - DNA, 27 bp; single-stranded, linear
  The letter "N" represents the stem II region of an HH ribozyme.
accugaaccugaugangaaagauccug

SEQ ID NO: 54 - DNA, 27 bp; single-stranded, linear
  The letter "N" represents the stem II region of an HH ribozyme.
ugaaccugcugaugangaaacuagauc

SEQ ID NO: 55 - DNA, 27 bp; single-stranded, linear
  The letter "N" represents the stem II region of an HH ribozyme.
uugaaccucugaugangaaaacuagau

SEQ ID NO: 56 - DNA, 27 bp; single-stranded, linear
  The letter "N" represents the stem II region of an HH ribozyme.
uaauuuugcugaugangaaaccugaac

SEQ ID NO: 57 - DNA, 27 bp; single-stranded, linear
  The letter "N" represents the stem II region of an HH ribozyme.
uuaauuuucugaugangaaaaccugaa

SEQ ID NO: 58 - DNA, 27 bp; single-stranded, linear
  The letter "N" represents the stem II region of an HH ribozyme.
gaucuuuucugaugangaaauuuugaa

SEQ ID NO: 59 - DNA, 27 bp; single-stranded, linear
  The letter "N" represents the stem II region of an HH ribozyme.
ggaucuuucugaugangaaaauuuuga

SEQ ID NO: 60 - DNA, 27 bp; single-stranded, linear
  The letter "N" represents the stem II region of an HH ribozyme.
caguucagcugaugangaaaucuuuua

SEQ ID NO: 61 - DNA, 27 bp; single-stranded, linear
  The letter "N" represents the stem II region of an HH ribozyme.
gccuuuuacugaugangaaacucaguu

SEQ ID NO: 62 - DNA, 27 bp; single-stranded, linear
  The letter "N" represents the stem II region of an HH ribozyme.
ugccuuuucugaugangaaaacucagu

SEQ ID NO: 63 - DNA, 27 bp; single-stranded, linear
  The letter "N" represents the stem II region of an HH ribozyme.
gugccuuucugaugangaaaaacucag

SEQ ID NO: 64 - DNA, 27 bp; single-stranded, linear
  The letter "N" represents the stem II region of an HH ribozyme.
gcuugcaucugaugangaaaugugcug

SEQ ID NO: 65 - DNA, 27 bp; single-stranded, linear
  The letter "N" represents the stem II region of an HH ribozyme.
gcauuggacugaugangaaaugcagug

SEQ ID NO: 66 - DNA, 27 bp; single-stranded, linear
  The letter "N" represents the stem II region of an HH ribozyme.
cugcauugcugaugangaaagaugcag

SEQ ID NO: 67 - DNA, 27 bp; single-stranded, linear
  The letter "N" represents the stem II region of an HH ribozyme.
agaccauucugaugangaaaugggcug

SEQ ID NO: 68 - DNA, 27 bp; single-stranded, linear
  The letter "N" represents the stem II region of an HH ribozyme.
caggcaaacugaugangaaaccauuua

SEQ ID NO: 69 - DNA, 27 bp; single-stranded, linear
  The letter "N" represents the stem II region of an HH ribozyme.
uucaggcacugaugangaaagaccauu

SEQ ID NO: 70 - DNA, 27 bp; single-stranded, linear
  The letter "N" represents the stem II region of an HH ribozyme.
uuucaggccugaugangaaaagaccau

SEQ ID NO: 71 - DNA, 27 bp; single-stranded, linear
  The letter "N" represents the stem II region of an HH ribozyme.
gcuuuccucugaugangaaacucacca

SEQ ID NO: 72 - DNA, 27 bp; single-stranded, linear
  The letter "N" represents the stem II region of an HH ribozyme.
gauuuagucugaugangaaaugcucag

SEQ ID NO: 73 - DNA, 27 bp; single-stranded, linear
  The letter "N" represents the stem II region of an HH ribozyme.
ggcagauucugaugangaaaguuaugc

SEQ ID NO: 74 - DNA, 27 bp; single-stranded, linear
  The letter "N" represents the stem II region of an HH ribozyme.
cacaggcacugaugangaaauuuaguu

SEQ ID NO: 75 - DNA, 27 bp; single-stranded, linear
  The letter "N" represents the stem II region of an HH ribozyme.
uacugcagcugaugangaaauuguuug

SEQ ID NO: 76 - DNA, 27 bp; single-stranded, linear
  The letter "N" represents the stem II region of an HH ribozyme.
guacugcacugaugangaaaauuguuu

SEQ ID NO: 77 - DNA, 27 bp; single-stranded, linear
  The letter "N" represents the stem II region of an HH ribozyme.
gguuaaagcugaugangaaacugcaga

SEQ ID NO: 78 - DNA, 27 bp; single-stranded, linear
  The letter "N" represents the stem II region of an HH ribozyme.
caagguuacugaugangaaaguacugc

SEQ ID NO: 79 - DNA, 27 bp; single-stranded, linear
  The letter "N" represents the stem II region of an HH ribozyme.
ucaagguucugaugangaaaaguacug

SEQ ID NO: 80 - DNA, 27 bp; single-stranded, linear
  The letter "N" represents the stem II region of an HH ribozyme.
uucaaggucugaugangaaaaaguacu

SEQ ID NO: 81 - DNA, 27 bp; single-stranded, linear
  The letter "N" represents the stem II region of an HH ribozyme.
cuguguuccugaugangaaagguuaaa

SEQ ID NO: 82 - DNA, 27 bp; single-stranded, linear
  The letter "N" represents the stem II region of an HH ribozyme.
guuugcuucugaugangaaagcugugu

SEQ ID NO: 83 - DNA, 27 bp; single-stranded, linear
  The letter "N" represents the stem II region of an HH ribozyme.
agcuguagcugaugangaaagccagug

SEQ ID NO: 84 - DNA, 27 bp; single-stranded, linear
  The letter "N" represents the stem II region of an HH ribozyme.
cagcuguacugaugangaaaagccagu

SEQ ID NO: 85 - DNA, 27 bp; single-stranded, linear
  The letter "N" represents the stem II region of an HH ribozyme.
ugcagcugcugaugangaaagaagcca

SEQ ID NO: 86 - DNA, 27 bp; single-stranded, linear
  The letter "N" represents the stem II region of an HH ribozyme.
cagcuagacugaugangaaauuugcag

SEQ ID NO: 87 - DNA, 27 bp; single-stranded, linear
  The letter "N" represents the stem II region of an HH ribozyme.
uacagcuacugaugangaaauauuugc

SEQ ID NO: 88 - DNA, 27 bp; single-stranded, linear
  The letter "N" represents the stem II region of an HH ribozyme.
gguacagccugaugangaaagauauuu

SEQ ID NO: 89 - DNA, 27 bp; single-stranded, linear
  The letter "N" represents the stem II region of an HH ribozyme.
gaaguaggcugaugangaaacagcuag

SEQ ID NO: 90 - DNA, 27 bp; single-stranded, linear
  The letter "N" represents the stem II region of an HH ribozyme.
cuuugaagcugaugangaaagguacag

SEQ ID NO: 91 - DNA, 27 bp; single-stranded, linear
  The letter "N" represents the stem II region of an HH ribozyme.
cuucuuugcugaugangaaaguaggua

SEQ ID NO: 92 - DNA, 27 bp; single-stranded, linear
  The letter "N" represents the stem II region of an HH ribozyme.
ucuucuuucugaugangaaaaguaggu

SEQ ID NO: 93 - DNA, 27 bp; single-stranded, linear
  The letter "N" represents the stem II region of an HH ribozyme.
agauugcacugaugangaaauucuguu

SEQ ID NO: 94 - DNA, 27 bp; single-stranded, linear
  The letter "N" represents the stem II region of an HH ribozyme.
aauauauacugaugangaaauugcaga

SEQ ID NO: 95 - DNA, 27 bp; single-stranded, linear
  The letter "N" represents the stem II region of an HH ribozyme.
uaaauauacugaugangaaagauugca

SEQ ID NO: 96 - DNA, 27 bp; single-stranded, linear
  The letter "N" represents the stem II region of an HH ribozyme.
aauaaauacugaugangaaauagauug

SEQ ID NO: 97 - DNA, 27 bp; single-stranded, linear
  The letter "N" represents the stem II region of an HH ribozyme.
cuaauaaacugaugangaaauauagau

SEQ ID NO: 98 - DNA, 27 bp; single-stranded, linear
  The letter "N" represents the stem II region of an HH ribozyme.
cacuaauacugaugangaaauauauag

SEQ ID NO: 99 - DNA, 27 bp; single-stranded, linear
  The letter "N" represents the stem II region of an HH ribozyme.
ucacuaaucugaugangaaaauauaua

SEQ ID NO: 100 - DNA, 27 bp; single-stranded, linear
  The letter "N" represents the stem II region of an HH ribozyme.
aucacuaacugaugangaaaaauauau

SEQ ID NO: 101 - DNA, 27 bp; single-stranded, linear
  The letter "N" represents the stem II region of an HH ribozyme.
guaucacucugaugangaaauaaauau

SEQ ID NO: 102 - DNA, 27 bp; single-stranded, linear
  The letter "N" represents the stem II region of an HH ribozyme.
uguaucaccugaugangaaaauaaaua

SEQ ID NO: 103 - DNA, 27 bp; single-stranded, linear
  The letter "N" represents the stem II region of an HH ribozyme.
ucuaccugcugaugangaaaucacuaa

SEQ ID NO: 104 - DNA, 27 bp; single-stranded, linear
  The letter "N" represents the stem II region of an HH ribozyme.
gaaagguccugaugangaaaccuguau

SEQ ID NO: 105 - DNA, 27 bp; single-stranded, linear
  The letter "N" represents the stem II region of an HH ribozyme.
cucuacgacugaugangaaaggucuac

SEQ ID NO: 106 - DNA, 27 bp; single-stranded, linear
  The letter "N" represents the stem II region of an HH ribozyme.
ucucuacgcugaugangaaaaggucua

SEQ ID NO: 107 - DNA, 27 bp; single-stranded, linear
  The letter "N" represents the stem II region of an HH ribozyme.
aucucuaccugaugangaaaaaggucu

SEQ ID NO: 108 - DNA, 27 bp; single-stranded, linear
  The letter "N" represents the stem II region of an HH ribozyme.
uacaucuccugaugangaaacgaaagg

SEQ ID NO: 109 - DNA, 27 bp; single-stranded, linear
  The letter "N" represents the stem II region of an HH ribozyme.
uuucacugcugaugangaaacaucucu

SEQ ID NO: 110 - DNA, 27 bp; single-stranded, linear
  The letter "N" represents the stem II region of an HH ribozyme.
auuucgggcugaugangaaauuucacu

SEQ ID NO: 111 - DNA, 27 bp; single-stranded, linear
  The letter "N" represents the stem II region of an HH ribozyme.
auguguaucugaugangaaauuucggg

SEQ ID NO: 112 - DNA, 27 bp; single-stranded, linear
  The letter "N" represents the stem II region of an HH ribozyme.
cauguguacugaugangaaaauuucgg

SEQ ID NO: 113 - DNA, 27 bp; single-stranded, linear
  The letter "N" represents the stem II region of an HH ribozyme.
gucaugugcugaugangaaauaauuuc

SEQ ID NO: 114 - DNA, 27 bp; single-stranded, linear
  The letter "N" represents the stem II region of an HH ribozyme.
ggaaugaccugaugangaaagcucccu

SEQ ID NO: 115 - DNA, 27 bp; single-stranded, linear
  The letter "N" represents the stem II region of an HH ribozyme.
cagggaaucugaugangaaacgagcuc

SEQ ID NO: 116 - DNA, 27 bp; single-stranded, linear
  The letter "N" represents the stem II region of an HH ribozyme.
cggcagggcugaugangaaaugacgag

SEQ ID NO: 117 - DNA, 27 bp; single-stranded, linear
  The letter "N" represents the stem II region of an HH ribozyme.
ccggcaggcugaugangaaaaugacga

SEQ ID NO: 118 - DNA, 27 bp; single-stranded, linear
  The letter "N" represents the stem II region of an HH ribozyme.
ggugacgucugaugangaaacccggca

SEQ ID NO: 119 - DNA, 27 bp; single-stranded, linear
  The letter "N" represents the stem II region of an HH ribozyme.
aggugacgcugaugangaaaacccggc

SEQ ID NO: 120 - DNA, 27 bp; single-stranded, linear
  The letter "N" represents the stem II region of an HH ribozyme.
uguuaggucugaugangaaacguaacc

SEQ ID NO: 121 - DNA, 27 bp; single-stranded, linear
  The letter "N" represents the stem II region of an HH ribozyme.
agugaugucugaugangaaaggugacg

SEQ ID NO: 122 - DNA, 27 bp; single-stranded, linear
  The letter "N" represents the stem II region of an HH ribozyme.
guaacagucugaugangaaauguuagg

SEQ ID NO: 123 - DNA, 27 bp; single-stranded, linear
  The letter "N" represents the stem II region of an HH ribozyme.
uuuaaagucugaugangaaacagugau

SEQ ID NO: 124 - DNA, 27 bp; single-stranded, linear
  The letter "N" represents the stem II region of an HH ribozyme.
uuuuaaagcugaugangaaaacaguga

SEQ ID NO: 125 - DNA, 27 bp; single-stranded, linear
  The letter "N" represents the stem II region of an HH ribozyme.
cuuuuuuacugaugangaaaguaacag

SEQ ID NO: 126 - DNA, 27 bp; single-stranded, linear
  The letter "N" represents the stem II region of an HH ribozyme.
acuuuuuucugaugangaaaaguaaca

SEQ ID NO: 127 - DNA, 27 bp; single-stranded, linear
  The letter "N" represents the stem II region of an HH ribozyme.
aacuuuuucugaugangaaaaaguaac

SEQ ID NO: 128 - DNA, 27 bp; single-stranded, linear
  The letter "N" represents the stem II region of an HH ribozyme.
caaguggacugaugangaaacuuuuuu

SEQ ID NO: 129 - DNA, 27 bp; single-stranded, linear
  The letter "N" represents the stem II region of an HH ribozyme.
ucaaguggcugaugangaaaacuuuuu

SEQ ID NO: 130 - DNA, 27 bp; single-stranded, linear
  The letter "N" represents the stem II region of an HH ribozyme.
gucaagugcugaugangaaaaacuuuu

SEQ ID NO: 131 - DNA, 27 bp; single-stranded, linear
  The letter "N" represents the stem II region of an HH ribozyme.
aaaguguccugaugangaaaguggaaa

SEQ ID NO: 132 - DNA, 27 bp; single-stranded, linear
  The letter "N" represents the stem II region of an HH ribozyme.
agggaucacugaugangaaagugucaa

SEQ ID NO: 133 - DNA, 27 bp; single-stranded, linear
  The letter "N" represents the stem II region of an HH ribozyme.
cagggauccugaugangaaaaguguca

SEQ ID NO: 134 - DNA, 27 bp; single-stranded, linear
  The letter "N" represents the stem II region of an HH ribozyme.
ccaucaggcugaugangaaaucaaagu

SEQ ID NO: 135 - DNA, 27 bp; single-stranded, linear
  The letter "N" represents the stem II region of an HH ribozyme.
ucccagaucugaugangaaaugcguuu

SEQ ID NO: 136 - DNA, 27 bp; single-stranded, linear
  The letter "N" represents the stem II region of an HH ribozyme.
cugucccacugaugangaaauuaugcg

SEQ ID NO: 137 - DNA, 27 bp; single-stranded, linear
  The letter "N" represents the stem II region of an HH ribozyme.
gcccuuuccugaugangaaacuguccc

SEQ ID NO: 138 - DNA, 27 bp; single-stranded, linear
  The letter "N" represents the stem II region of an HH ribozyme.
auaugaugcugaugangaaagcccuuu

SEQ ID NO: 139 - DNA, 27 bp; single-stranded, linear
  The letter "N" represents the stem II region of an HH ribozyme.
gauaugaucugaugangaaaagcccuu

SEQ ID NO: 140 - DNA, 27 bp; single-stranded, linear
  The letter "N" represents the stem II region of an HH ribozyme.
uuugauaucugaugangaaaugaagcc

SEQ ID NO: 141 - DNA, 27 bp; single-stranded, linear
  The letter "N" represents the stem II region of an HH ribozyme.
gcauuugacugaugangaaaugaugaa

SEQ ID NO: 142 - DNA, 27 bp; single-stranded, linear
  The letter "N" represents the stem II region of an HH ribozyme.
uugcauuucugaugangaaauaugaug

SEQ ID NO: 143 - DNA, 27 bp; single-stranded, linear
  The letter "N" represents the stem II region of an HH ribozyme.
uuucuuugcugaugangaaacguugca

SEQ ID NO: 144 - DNA, 27 bp; single-stranded, linear
  The letter "N" represents the stem II region of an HH ribozyme.
agaagccccugaugangaaauuucuuu

SEQ ID NO: 145 - DNA, 27 bp; single-stranded, linear
  The letter "N" represents the stem II region of an HH ribozyme.
caggucagcugaugangaaagcccuau

SEQ ID NO: 146 - DNA, 27 bp; single-stranded, linear
  The letter "N" represents the stem II region of an HH ribozyme.
acaggucacugaugangaaaagcccua

SEQ ID NO: 147 - DNA, 27 bp; single-stranded, linear
  The letter "N" represents the stem II region of an HH ribozyme.
ugcccauucugaugangaaacuguugc

SEQ ID NO: 148 - DNA, 27 bp; single-stranded, linear
  The letter "N" represents the stem II region of an HH ribozyme.
cuuauacacugaugangaaaugcccau

SEQ ID NO: 149 - DNA, 27 bp; single-stranded, linear
  The letter "N" represents the stem II region of an HH ribozyme.
ucuuauaccugaugangaaaaugccca

SEQ ID NO: 150 - DNA, 27 bp; single-stranded, linear
  The letter "N" represents the stem II region of an HH ribozyme.
uugucuuacugaugangaaacaaaugc

SEQ ID NO: 151 - DNA, 27 bp; single-stranded, linear
  The letter "N" represents the stem II region of an HH ribozyme.
guuugucucugaugangaaauacaaau

SEQ ID NO: 152 - DNA, 27 bp; single-stranded, linear
  The letter "N" represents the stem II region of an HH ribozyme.
gugugagacugaugangaaaguuuguc

SEQ ID NO: 153 - DNA, 27 bp; single-stranded, linear
  The letter "N" represents the stem II region of an HH ribozyme.
augugugacugaugangaaauaguuug

SEQ ID NO: 154 - DNA, 27 bp; single-stranded, linear
  The letter "N" represents the stem II region of an HH ribozyme.
cgaugugucugaugangaaagauaguu

SEQ ID NO: 155 - DNA, 27 bp; single-stranded, linear
  The letter "N" represents the stem II region of an HH ribozyme.
gguuuguccugaugangaaauguguga

SEQ ID NO: 156 - DNA, 27 bp; single-stranded, linear
  The letter "N" represents the stem II region of an HH ribozyme.
uaugauugcugaugangaaauugguuu

SEQ ID NO: 157 - DNA, 27 bp; single-stranded, linear
  The letter "N" represents the stem II region of an HH ribozyme.
acaucuaucugaugangaaauuguauu

SEQ ID NO: 158 - DNA, 27 bp; single-stranded, linear
  The letter "N" represents the stem II region of an HH ribozyme.
uggacauccugaugangaaaugauugu

SEQ ID NO: 159 - DNA, 27 bp; single-stranded, linear
  The letter "N" represents the stem II region of an HH ribozyme.
cuuauuugcugaugangaaacaucuau

SEQ ID NO: 160 - DNA, 27 bp; single-stranded, linear
  The letter "N" represents the stem II region of an HH ribozyme.
ggugugcucugaugangaaauuuggac

SEQ ID NO: 161 - DNA, 27 bp; single-stranded, linear
  The letter "N" represents the stem II region of an HH ribozyme.
aguaauuucugaugangaaacugggcg

SEQ ID NO: 162 - DNA, 27 bp; single-stranded, linear
  The letter "N" represents the stem II region of an HH ribozyme.
cucuaagucugaugangaaauuugacu

SEQ ID NO: 163 - DNA, 27 bp; single-stranded, linear
  The letter "N" represents the stem II region of an HH ribozyme.
ccucuaagcugaugangaaaauuugac

SEQ ID NO: 164 - DNA, 27 bp; single-stranded, linear
  The letter "N" represents the stem II region of an HH ribozyme.
uggccucucugaugangaaaguaauuu

SEQ ID NO: 165 - DNA, 27 bp; single-stranded, linear
  The letter "N" represents the stem II region of an HH ribozyme.
auggccuccugaugangaaaaguaauu

SEQ ID NO: 166 - DNA, 27 bp; single-stranded, linear
  The letter "N" represents the stem II region of an HH ribozyme.
gacaagagcugaugangaaauggccuc

SEQ ID NO: 167 - DNA, 27 bp; single-stranded, linear
  The letter "N" represents the stem II region of an HH ribozyme.
gaggacaacugaugangaaaguauggc

SEQ ID NO: 168 - DNA, 27 bp; single-stranded, linear
  The letter "N" represents the stem II region of an HH ribozyme.
uugaggaccugaugangaaagaguaug

SEQ ID NO: 169 - DNA, 27 bp; single-stranded, linear
  The letter "N" represents the stem II region of an HH ribozyme.
caauugagcugaugangaaacaagagu

SEQ ID NO: 170 - DNA, 27 bp; single-stranded, linear
  The letter "N" represents the stem II region of an HH ribozyme.
guacaauucugaugangaaaggacaag

SEQ ID NO: 171 - DNA, 27 bp; single-stranded, linear
  The letter "N" represents the stem II region of an HH ribozyme.
agcaguaccugaugangaaauugagga

SEQ ID NO: 172 - DNA, 27 bp; single-stranded, linear
  The letter "N" represents the stem II region of an HH ribozyme.
gguagcagcugaugangaaacaauuga

SEQ ID NO: 173 - DNA, 27 bp; single-stranded, linear
  The letter "N" represents the stem II region of an HH ribozyme.
gggaguggcugaugangaaagcaguac

SEQ ID NO: 174 - DNA, 27 bp; single-stranded, linear
  The letter "N" represents the stem II region of an HH ribozyme.
guucaaggcugaugangaaagugguag

SEQ ID NO: 175 - DNA, 27 bp; single-stranded, linear
  The letter "N" represents the stem II region of an HH ribozyme.
ucguguuccugaugangaaagggagug

SEQ ID NO: 176 - DNA, 27 bp; single-stranded, linear
  The letter "N" represents the stem II region of an HH ribozyme.
gucauuugcugaugangaaacucucgu

SEQ ID NO: 177 - DNA, 27 bp; single-stranded, linear
  The letter "N" represents the stem II region of an HH ribozyme.
ggucauuucugaugangaaaacucucg

SEQ ID NO: 178 - DNA, 27 bp; single-stranded, linear
  The letter "N" represents the stem II region of an HH ribozyme.
aucagggucugaugangaaacuccagg

SEQ ID NO: 179 - DNA, 27 bp; single-stranded, linear
  The letter "N" represents the stem II region of an HH ribozyme.
caucagggcugaugangaaaacuccag

SEQ ID NO: 180 - DNA, 27 bp; single-stranded, linear
  The letter "N" represents the stem II region of an HH ribozyme.
agcucucucugaugangaaauuuuuuu

SEQ ID NO: 181 - DNA, 27 bp; single-stranded, linear
  The letter "N" represents the stem II region of an HH ribozyme.
ccuuacggcugaugangaaagcucucu

SEQ ID NO: 182 - DNA, 27 bp; single-stranded, linear
  The letter "N" represents the stem II region of an HH ribozyme.
gccuuacgcugaugangaaaagcucuc

SEQ ID NO: 183 - DNA, 27 bp; single-stranded, linear
  The letter "N" represents the stem II region of an HH ribozyme.
cgucgccucugaugangaaacggaagc

SEQ ID NO: 184 - DNA, 27 bp; single-stranded, linear
  The letter "N" represents the stem II region of an HH ribozyme.
cuuugguccugaugangaaauucgucg

SEQ ID NO: 185 - DNA, 27 bp; single-stranded, linear
  The letter "N" represents the stem II region of an HH ribozyme.
ggcaugggcugaugangaaauugcuuu

SEQ ID NO: 186 - DNA, 27 bp; single-stranded, linear
  The letter "N" represents the stem II region of an HH ribozyme.
uggcauggcugaugangaaaauugcuu

SEQ ID NO: 187 - DNA, 27 bp; single-stranded, linear
  The letter "N" represents the stem II region of an HH ribozyme.
cuguagaacugaugangaaauguuggc

SEQ ID NO: 188 - DNA, 27 bp; single-stranded, linear
  The letter "N" represents the stem II region of an HH ribozyme.
cacuguagcugaugangaaauauguug

SEQ ID NO: 189 - DNA, 27 bp; single-stranded, linear
  The letter "N" represents the stem II region of an HH ribozyme.
acacuguacugaugangaaaauauguu

SEQ ID NO: 190 - DNA, 27 bp; single-stranded, linear
  The letter "N" represents the stem II region of an HH ribozyme.
gaacacugcugaugangaaagaauaug

SEQ ID NO: 191 - DNA, 27 bp; single-stranded, linear
  The letter "N" represents the stem II region of an HH ribozyme.
auaguaagcugaugangaaacacugua

SEQ ID NO: 192 - DNA, 27 bp; single-stranded, linear
  The letter "N" represents the stem II region of an HH ribozyme.
aauaguaacugaugangaaaacacugu

SEQ ID NO: 193 - DNA, 27 bp; single-stranded, linear
  The letter "N" represents the stem II region of an HH ribozyme.
ucaauagucugaugangaaagaacacu

SEQ ID NO: 194 - DNA, 27 bp; single-stranded, linear
  The letter "N" represents the stem II region of an HH ribozyme.
gucaauagcugaugangaaaagaacac

SEQ ID NO: 195 - DNA, 27 bp; single-stranded, linear
  The letter "N" represents the stem II region of an HH ribozyme.
uuugucaacugaugangaaaguaagaa

SEQ ID NO: 196 - DNA, 27 bp; single-stranded, linear
  The letter "N" represents the stem II region of an HH ribozyme.
auuuuguccugaugangaaauaguaag

SEQ ID NO: 197 - DNA, 27 bp; single-stranded, linear
  The letter "N" represents the stem II region of an HH ribozyme.
caaguauacugaugangaaaguccuuu

SEQ ID NO: 198 - DNA, 27 bp; single-stranded, linear
  The letter "N" represents the stem II region of an HH ribozyme.
acaaguaucugaugangaaaaguccuu

SEQ ID NO: 199 - DNA, 27 bp; single-stranded, linear
  The letter "N" represents the stem II region of an HH ribozyme.
gacaaguacugaugangaaaaaguccu

SEQ ID NO: 200 - DNA, 27 bp; single-stranded, linear
  The letter "N" represents the stem II region of an HH ribozyme.
acgacaagcugaugangaaauaaaguc

SEQ ID NO: 201 - DNA, 27 bp; single-stranded, linear
  The letter "N" represents the stem II region of an HH ribozyme.
uacacgaccugaugangaaaguauaaa

SEQ ID NO: 202 - DNA, 27 bp; single-stranded, linear
  The letter "N" represents the stem II region of an HH ribozyme.
ccuuacaccugaugangaaacaaguau

SEQ ID NO: 203 - DNA, 27 bp; single-stranded, linear
  The letter "N" represents the stem II region of an HH ribozyme.
ccacuccucugaugangaaacacgaca

SEQ ID NO: 204 - DNA, 27 bp; single-stranded, linear
  The letter "N" represents the stem II region of an HH ribozyme.
auuugaaucugaugangaaauggucca

SEQ ID NO: 205 - DNA, 27 bp; single-stranded, linear
  The letter "N" represents the stem II region of an HH ribozyme.
cagauuugcugaugangaaaugauggu

SEQ ID NO: 206 - DNA, 27 bp; single-stranded, linear
  The letter "N" represents the stem II region of an HH ribozyme.
acagauuucugaugangaaaaugaugg

SEQ ID NO: 207 - DNA, 27 bp; single-stranded, linear
  The letter "N" represents the stem II region of an HH ribozyme.
uguuaacacugaugangaaauuugaau

SEQ ID NO: 208 - DNA, 27 bp; single-stranded, linear
  The letter "N" represents the stem II region of an HH ribozyme.
gagguguucugaugangaaacagauuu

SEQ ID NO: 209 - DNA, 27 bp; single-stranded, linear
  The letter "N" represents the stem II region of an HH ribozyme.
ugaggugucugaugangaaaacagauu

SEQ ID NO: 210 - DNA, 27 bp; single-stranded, linear
  The letter "N" represents the stem II region of an HH ribozyme.
uaugcacucugaugangaaagguguua

SEQ ID NO: 211 - DNA, 27 bp; single-stranded, linear
  The letter "N" represents the stem II region of an HH ribozyme.
aucauauacugaugangaaaugcacug

SEQ ID NO: 212 - DNA, 27 bp; single-stranded, linear
  The letter "N" represents the stem II region of an HH ribozyme.
uuaucauacugaugangaaauaugcac

SEQ ID NO: 213 - DNA, 27 bp; single-stranded, linear
  The letter "N" represents the stem II region of an HH ribozyme.
cuuuaucacugaugangaaauauaugc

SEQ ID NO: 214 - DNA, 27 bp; single-stranded, linear
  The letter "N" represents the stem II region of an HH ribozyme.
gaaugcuucugaugangaaaucauaua

SEQ ID NO: 215 - DNA, 27 bp; single-stranded, linear
  The letter "N" represents the stem II region of an HH ribozyme.
cagugaugcugaugangaaaugcuuua

SEQ ID NO: 216 - DNA, 27 bp; single-stranded, linear
  The letter "N" represents the stem II region of an HH ribozyme.
acagugaucugaugangaaaaugcuuu

SEQ ID NO: 217 - DNA, 27 bp; single-stranded, linear
  The letter "N" represents the stem II region of an HH ribozyme.
uucacagucugaugangaaaugaaugc

SEQ ID NO: 218 - DNA, 27 bp; single-stranded, linear
  The letter "N" represents the stem II region of an HH ribozyme.
cuguuuuccugaugangaaauguuuca

SEQ ID NO: 219 - DNA, 27 bp; single-stranded, linear
  The letter "N" represents the stem II region of an HH ribozyme.
acgguuuccugaugangaaagcaccug

SEQ ID NO: 220 - DNA, 27 bp; single-stranded, linear
  The letter "N" represents the stem II region of an HH ribozyme.
uugccagccugaugangaaacgguuuc

SEQ ID NO: 221 - DNA, 27 bp; single-stranded, linear
  The letter "N" represents the stem II region of an HH ribozyme.
gccgguaacugaugangaaaccgcuug

SEQ ID NO: 222 - DNA, 27 bp; single-stranded, linear
  The letter "N" represents the stem II region of an HH ribozyme.
gagccggucugaugangaaagaccgcu

SEQ ID NO: 223 - DNA, 27 bp; single-stranded, linear
  The letter "N" represents the stem II region of an HH ribozyme.
agagccggcugaugangaaaagaccgc

SEQ ID NO: 224 - DNA, 27 bp; single-stranded, linear
  The letter "N" represents the stem II region of an HH ribozyme.
uucauagacugaugangaaagccggua

SEQ ID NO: 225 - DNA, 27 bp; single-stranded, linear
  The letter "N" represents the stem II region of an HH ribozyme.
cuuucauacugaugangaaagagccgg

SEQ ID NO: 226 - DNA, 27 bp; single-stranded, linear
  The letter "N" represents the stem II region of an HH ribozyme.
cacuuucacugaugangaaagagagcc

SEQ ID NO: 227 - DNA, 27 bp; single-stranded, linear
  The letter "N" represents the stem II region of an HH ribozyme.
gcgagggacugaugangaaaugccuuc

SEQ ID NO: 228 - DNA, 27 bp; single-stranded, linear
  The letter "N" represents the stem II region of an HH ribozyme.
ggcgagggcugaugangaaaaugccuu

SEQ ID NO: 229 - DNA, 27 bp; single-stranded, linear
  The letter "N" represents the stem II region of an HH ribozyme.
cggcgaggcugaugangaaaaaugccu

SEQ ID NO: 230 - DNA, 27 bp; single-stranded, linear
  The letter "N" represents the stem II region of an HH ribozyme.
cuuccggccugaugangaaagggaaau

SEQ ID NO: 231 - DNA, 27 bp; single-stranded, linear
  The letter "N" represents the stem II region of an HH ribozyme.
aaccauaccugaugangaaacuuccgg

SEQ ID NO: 232 - DNA, 27 bp; single-stranded, linear
  The letter "N" represents the stem II region of an HH ribozyme.
uuuaaccacugaugangaaacaacuuc

SEQ ID NO: 233 - DNA, 27 bp; single-stranded, linear
  The letter "N" represents the stem II region of an HH ribozyme.
caucuuuucugaugangaaaccauaca

SEQ ID NO: 234 - DNA, 27 bp; single-stranded, linear
  The letter "N" represents the stem II region of an HH ribozyme.
ccaucuuucugaugangaaaaccauac

SEQ ID NO: 235 - DNA, 27 bp; single-stranded, linear
  The letter "N" represents the stem II region of an HH ribozyme.
ucgcaggucugaugangaaacccaucu

SEQ ID NO: 236 - DNA, 27 bp; single-stranded, linear
  The letter "N" represents the stem II region of an HH ribozyme.
gucgcaggcugaugangaaaacccauc

SEQ ID NO: 237 - DNA, 27 bp; single-stranded, linear
  The letter "N" represents the stem II region of an HH ribozyme.
agcgagcacugaugangaaauuucuca

SEQ ID NO: 238 - DNA, 27 bp; single-stranded, linear
  The letter "N" represents the stem II region of an HH ribozyme.
caaauagccugaugangaaagcagauu

SEQ ID NO: 239 - DNA, 27 bp; single-stranded, linear
  The letter "N" represents the stem II region of an HH ribozyme.
gagucaaacugaugangaaagcgagca

SEQ ID NO: 240 - DNA, 27 bp; single-stranded, linear
  The letter "N" represents the stem II region of an HH ribozyme.
acgagucacugaugangaaauagcgag

SEQ ID NO: 241 - DNA, 27 bp; single-stranded, linear
  The letter "N" represents the stem II region of an HH ribozyme.
cacgaguccugaugangaaaauagcga

SEQ ID NO: 242 - DNA, 27 bp; single-stranded, linear
  The letter "N" represents the stem II region of an HH ribozyme.
guagccaccugaugangaaagucaaau

SEQ ID NO: 243 - DNA, 27 bp; single-stranded, linear
  The letter "N" represents the stem II region of an HH ribozyme.
uuaacgagcugaugangaaagccacga

SEQ ID NO: 244 - DNA, 27 bp; single-stranded, linear
  The letter "N" represents the stem II region of an HH ribozyme.
uaauuaaccugaugangaaaguagcca

SEQ ID NO: 245 - DNA, 27 bp; single-stranded, linear
  The letter "N" represents the stem II region of an HH ribozyme.
ugauaauucugaugangaaacgaguag

SEQ ID NO: 246 - DNA, 27 bp; single-stranded, linear
  The letter "N" represents the stem II region of an HH ribozyme.
uugauaaucugaugangaaaacgagua

SEQ ID NO: 247 - DNA, 27 bp; single-stranded, linear
  The letter "N" represents the stem II region of an HH ribozyme.
uccuugaucugaugangaaauuaacga

SEQ ID NO: 248 - DNA, 27 bp; single-stranded, linear
  The letter "N" represents the stem II region of an HH ribozyme.
guccuugacugaugangaaaauuaacg

SEQ ID NO: 249 - DNA, 27 bp; single-stranded, linear
  The letter "N" represents the stem II region of an HH ribozyme.
acguccuucugaugangaaauaauuaa

SEQ ID NO: 250 - DNA, 27 bp; single-stranded, linear
  The letter "N" represents the stem II region of an HH ribozyme.
ucuucagucugaugangaaacguccuu

SEQ ID NO: 251 - DNA, 27 bp; single-stranded, linear
  The letter "N" represents the stem II region of an HH ribozyme.
gauuguaucugaugangaaauucccug

SEQ ID NO: 252 - DNA, 27 bp; single-stranded, linear
  The letter "N" represents the stem II region of an HH ribozyme.
agauuguacugaugangaaaauucccu

SEQ ID NO: 253 - DNA, 27 bp; single-stranded, linear
  The letter "N" represents the stem II region of an HH ribozyme.
caagauugcugaugangaaauaauucc

SEQ ID NO: 254 - DNA, 27 bp; single-stranded, linear
  The letter "N" represents the stem II region of an HH ribozyme.
cucagcaacugaugangaaauuguaua

SEQ ID NO: 255 - DNA, 27 bp; single-stranded, linear
  The letter "N" represents the stem II region of an HH ribozyme.
ugcucagccugaugangaaagauugua

SEQ ID NO: 256 - DNA, 27 bp; single-stranded, linear
  The letter "N" represents the stem II region of an HH ribozyme.
gacuguuucugaugangaaaugcucag

SEQ ID NO: 257 - DNA, 27 bp; single-stranded, linear
  The letter "N" represents the stem II region of an HH ribozyme.
acacauuucugaugangaaacuguuuu

SEQ ID NO: 258 - DNA, 27 bp; single-stranded, linear
  The letter "N" represents the stem II region of an HH ribozyme.
gguuuuuacugaugangaaacacauuu

SEQ ID NO: 259 - DNA, 27 bp; single-stranded, linear
  The letter "N" represents the stem II region of an HH ribozyme.
agguuuuucugaugangaaaacacauu

SEQ ID NO: 260 - DNA, 27 bp; single-stranded, linear
  The letter "N" represents the stem II region of an HH ribozyme.
gagguuuucugaugangaaaaacacau

SEQ ID NO: 261 - DNA, 27 bp; single-stranded, linear
  The letter "N" represents the stem II region of an HH ribozyme.
guggcagucugaugangaaagguuuuu

SEQ ID NO: 262 - DNA, 27 bp; single-stranded, linear
  The letter "N" represents the stem II region of an HH ribozyme.
gacaauuacugaugangaaaguggcag

SEQ ID NO: 263 - DNA, 27 bp; single-stranded, linear
  The letter "N" represents the stem II region of an HH ribozyme.
uugacaaucugaugangaaagaguggc

SEQ ID NO: 264 - DNA, 27 bp; single-stranded, linear
  The letter "N" represents the stem II region of an HH ribozyme.
acauugaccugaugangaaauuagagu

SEQ ID NO: 265 - DNA, 27 bp; single-stranded, linear
  The letter "N" represents the stem II region of an HH ribozyme.
uucacauucugaugangaaacaauuag

SEQ ID NO: 266 - DNA, 27 bp; single-stranded, linear
  The letter "N" represents the stem II region of an HH ribozyme.
uuuucguacugaugangaaaucugggg

SEQ ID NO: 267 - DNA, 27 bp; single-stranded, linear
  The letter "N" represents the stem II region of an HH ribozyme.
cuuuucgucugaugangaaaaucuggg

SEQ ID NO: 268 - DNA, 27 bp; single-stranded, linear
  The letter "N" represents the stem II region of an HH ribozyme.
ccuuuucgcugaugangaaaaaucugg

SEQ ID NO: 269 - DNA, 27 bp; single-stranded, linear
  The letter "N" represents the stem II region of an HH ribozyme.
gaaacgaucugaugangaaacacggcc

SEQ ID NO: 270 - DNA, 27 bp; single-stranded, linear
  The letter "N" represents the stem II region of an HH ribozyme.
cuggaaaccugaugangaaaugacacg

SEQ ID NO: 271 - DNA, 27 bp; single-stranded, linear
  The letter "N" represents the stem II region of an HH ribozyme.
ggucuggacugaugangaaacgaugac

SEQ ID NO: 272 - DNA, 27 bp; single-stranded, linear
  The letter "N" represents the stem II region of an HH ribozyme.
gggucuggcugaugangaaaacgauga

SEQ ID NO: 273 - DNA, 27 bp; single-stranded, linear
  The letter "N" represents the stem II region of an HH ribozyme.
cgggucugcugaugangaaaaacgaug

SEQ ID NO: 274 - DNA, 27 bp; single-stranded, linear
  The letter "N" represents the stem II region of an HH ribozyme.
uggguagacugaugangaaagccgggu

SEQ ID NO: 275 - DNA, 27 bp; single-stranded, linear
  The letter "N" represents the stem II region of an HH ribozyme.
aguggguacugaugangaaagagccgg

SEQ ID NO: 276 - DNA, 27 bp; single-stranded, linear
  The letter "N" represents the stem II region of an HH ribozyme.
ccagugggcugaugangaaagagagcc

SEQ ID NO: 277 - DNA, 27 bp; single-stranded, linear
  The letter "N" represents the stem II region of an HH ribozyme.
caagucagcugaugangaaauuugucu

SEQ ID NO: 278 - DNA, 27 bp; single-stranded, linear
  The letter "N" represents the stem II region of an HH ribozyme.
ugcgguaccugaugangaaagucagga

SEQ ID NO: 279 - DNA, 27 bp; single-stranded, linear
  The letter "N" represents the stem II region of an HH ribozyme.
auaugcggcugaugangaaacaaguca

SEQ ID NO: 280 - DNA, 27 bp; single-stranded, linear
  The letter "N" represents the stem II region of an HH ribozyme.
ggauaccacugaugangaaaugcggua

SEQ ID NO: 281 - DNA, 27 bp; single-stranded, linear
  The letter "N" represents the stem II region of an HH ribozyme.
uugagggacugaugangaaaccauaug

SEQ ID NO: 282 - DNA, 27 bp; single-stranded, linear
  The letter "N" represents the stem II region of an HH ribozyme.
gguugaggcugaugangaaauaccaua

SEQ ID NO: 283 - DNA, 27 bp; single-stranded, linear
  The letter "N" represents the stem II region of an HH ribozyme.
uguagguucugaugangaaagggauac

SEQ ID NO: 284 - DNA, 27 bp; single-stranded, linear
  The letter "N" represents the stem II region of an HH ribozyme.
cuugauugcugaugangaaagguugag

SEQ ID NO: 285 - DNA, 27 bp; single-stranded, linear
  The letter "N" represents the stem II region of an HH ribozyme.
aaccacuucugaugangaaauuguagg

SEQ ID NO: 286 - DNA, 27 bp; single-stranded, linear
  The letter "N" represents the stem II region of an HH ribozyme.
ggugccagcugaugangaaaccacuug

SEQ ID NO: 287 - DNA, 27 bp; single-stranded, linear
  The letter "N" represents the stem II region of an HH ribozyme.
gggugccacugaugangaaaaccacuu

SEQ ID NO: 288 - DNA, 27 bp; single-stranded, linear
  The letter "N" represents the stem II region of an HH ribozyme.
auuauggucugaugangaaacaggggu

SEQ ID NO: 289 - DNA, 27 bp; single-stranded, linear
  The letter "N" represents the stem II region of an HH ribozyme.
ggaaugaucugaugangaaaugguuac

SEQ ID NO: 290 - DNA, 27 bp; single-stranded, linear
  The letter "N" represents the stem II region of an HH ribozyme.
uucggaaucugaugangaaauuauggu

SEQ ID NO: 291 - DNA, 27 bp; single-stranded, linear
  The letter "N" represents the stem II region of an HH ribozyme.
ugcuucggcugaugangaaaugauuau

SEQ ID NO: 292 - DNA, 27 bp; single-stranded, linear
  The letter "N" represents the stem II region of an HH ribozyme.
uugcuucgcugaugangaaaaugauua

SEQ ID NO: 293 - DNA, 27 bp; single-stranded, linear
  The letter "N" represents the stem II region of an HH ribozyme.
uggaacaacugaugangaaagucacac

SEQ ID NO: 294 - DNA, 27 bp; single-stranded, linear
  The letter "N" represents the stem II region of an HH ribozyme.
uuggaacacugaugangaaaagucaca

SEQ ID NO: 295 - DNA, 27 bp; single-stranded, linear
  The letter "N" represents the stem II region of an HH ribozyme.
auuggaaccugaugangaaaaagucac

SEQ ID NO: 296 - DNA, 27 bp; single-stranded, linear
  The letter "N" represents the stem II region of an HH ribozyme.
auuauuggcugaugangaaacaaaagu

SEQ ID NO: 297 - DNA, 27 bp; single-stranded, linear
  The letter "N" represents the stem II region of an HH ribozyme.
cauuauugcugaugangaaaacaaaag

SEQ ID NO: 298 - DNA, 27 bp; single-stranded, linear
  The letter "N" represents the stem II region of an HH ribozyme.
cucuucaucugaugangaaauuggaac

SEQ ID NO: 299 - DNA, 27 bp; single-stranded, linear
  The letter "N" represents the stem II region of an HH ribozyme.
ggauaaagcugaugangaaacucuuca

SEQ ID NO: 300 - DNA, 27 bp; single-stranded, linear
  The letter "N" represents the stem II region of an HH ribozyme.
ccaggauacugaugangaaaggacucu

SEQ ID NO: 301 - DNA, 27 bp; single-stranded, linear
  The letter "N" represents the stem II region of an HH ribozyme.
uccaggaucugaugangaaaaggacuc

SEQ ID NO: 302 - DNA, 27 bp; single-stranded, linear
  The letter "N" represents the stem II region of an HH ribozyme.
auccaggacugaugangaaaaaggacu

SEQ ID NO: 303 - DNA, 27 bp; single-stranded, linear
  The letter "N" represents the stem II region of an HH ribozyme.
gcauccagcugaugangaaauaaagga

SEQ ID NO: 304 - DNA, 27 bp; single-stranded, linear
  The letter "N" represents the stem II region of an HH ribozyme.
augcucuccugaugangaaauucuguu

SEQ ID NO: 305 - DNA, 27 bp; single-stranded, linear
  The letter "N" represents the stem II region of an HH ribozyme.
cgcugagucugaugangaaaugcucuc

SEQ ID NO: 306 - DNA, 27 bp; single-stranded, linear
  The letter "N" represents the stem II region of an HH ribozyme.
caugcgcucugaugangaaagugaugc

SEQ ID NO: 307 - DNA, 27 bp; single-stranded, linear
  The letter "N" represents the stem II region of an HH ribozyme.
ccuucuaucugaugangaaauugccau

SEQ ID NO: 308 - DNA, 27 bp; single-stranded, linear
  The letter "N" represents the stem II region of an HH ribozyme.
uuuccuuccugaugangaaauuauugc

SEQ ID NO: 309 - DNA, 27 bp; single-stranded, linear
  The letter "N" represents the stem II region of an HH ribozyme.
agccaucucugaugangaaauucuuuc

SEQ ID NO: 310 - DNA, 27 bp; single-stranded, linear
  The letter "N" represents the stem II region of an HH ribozyme.
caaggugccugaugangaaagccaucu

SEQ ID NO: 311 - DNA, 27 bp; single-stranded, linear
  The letter "N" represents the stem II region of an HH ribozyme.
ccacaacccugaugangaaaggugcua

SEQ ID NO: 312 - DNA, 27 bp; single-stranded, linear
  The letter "N" represents the stem II region of an HH ribozyme.
ucagccaccugaugangaaaccaaggu

SEQ ID NO: 313 - DNA, 27 bp; single-stranded, linear
  The letter "N" represents the stem II region of an HH ribozyme.
aaauucuacugaugangaaagucagcc

SEQ ID NO: 314 - DNA, 27 bp; single-stranded, linear
  The letter "N" represents the stem II region of an HH ribozyme.
agaaauuccugaugangaaagagucag

SEQ ID NO: 315 - DNA, 27 bp; single-stranded, linear
  The letter "N" represents the stem II region of an HH ribozyme.
auuccagacugaugangaaauucuaga

SEQ ID NO: 316 - DNA, 27 bp; single-stranded, linear
  The letter "N" represents the stem II region of an HH ribozyme.
gauuccagcugaugangaaaauucuag

SEQ ID NO: 317 - DNA, 27 bp; single-stranded, linear
  The letter "N" represents the stem II region of an HH ribozyme.
agauuccacugaugangaaaaauucua

SEQ ID NO: 318 - DNA, 27 bp; single-stranded, linear
  The letter "N" represents the stem II region of an HH ribozyme.
caaauguacugaugangaaauuccaga

SEQ ID NO: 319 - DNA, 27 bp; single-stranded, linear
  The letter "N" represents the stem II region of an HH ribozyme.
ugcaaaugcugaugangaaagauucca

SEQ ID NO: 320 - DNA, 27 bp; single-stranded, linear
  The letter "N" represents the stem II region of an HH ribozyme.
gcuaugcacugaugangaaauguagau

SEQ ID NO: 321 - DNA, 27 bp; single-stranded, linear
  The letter "N" represents the stem II region of an HH ribozyme.
agcuaugccugaugangaaaauguaga

SEQ ID NO: 322 - DNA, 27 bp; single-stranded, linear
  The letter "N" represents the stem II region of an HH ribozyme.
uuggaagccugaugangaaaugcaaau

SEQ ID NO: 323 - DNA, 27 bp; single-stranded, linear
  The letter "N" represents the stem II region of an HH ribozyme.
uuuauuggcugaugangaaagcuaugc

SEQ ID NO: 324 - DNA, 27 bp; single-stranded, linear
  The letter "N" represents the stem II region of an HH ribozyme.
cuuuauugcugaugangaaaagcuaug

SEQ ID NO: 325 - DNA, 27 bp; single-stranded, linear
  The letter "N" represents the stem II region of an HH ribozyme.
cccaacuucugaugangaaauuggaag

SEQ ID NO: 326 - DNA, 27 bp; single-stranded, linear
  The letter "N" represents the stem II region of an HH ribozyme.
acaguccccugaugangaaacuuuauu

SEQ ID NO: 327 - DNA, 27 bp; single-stranded, linear
  The letter "N" represents the stem II region of an HH ribozyme.
uaaaagcucugaugangaaauguuucu

SEQ ID NO: 328 - DNA, 27 bp; single-stranded, linear
  The letter "N" represents the stem II region of an HH ribozyme.
ugauauaacugaugangaaagcuuaug

SEQ ID NO: 329 - DNA, 27 bp; single-stranded, linear
  The letter "N" represents the stem II region of an HH ribozyme.
gugauauacugaugangaaaagcuuau

SEQ ID NO: 330 - DNA, 27 bp; single-stranded, linear
  The letter "N" represents the stem II region of an HH ribozyme.
ugugauaucugaugangaaaaagcuua

SEQ ID NO: 331 - DNA, 27 bp; single-stranded, linear
  The letter "N" represents the stem II region of an HH ribozyme.
cugugauacugaugangaaaaaagcuu

SEQ ID NO: 332 - DNA, 27 bp; single-stranded, linear
  The letter "N" represents the stem II region of an HH ribozyme.
aucugugacugaugangaaauaaaagc

SEQ ID NO: 333 - DNA, 27 bp; single-stranded, linear
  The letter "N" represents the stem II region of an HH ribozyme.
acaucugucugaugangaaauauaaaa

SEQ ID NO: 334 - DNA, 27 bp; single-stranded, linear
  The letter "N" represents the stem II region of an HH ribozyme.
uaacaugacugaugangaaacccauuu

SEQ ID NO: 335 - DNA, 27 bp; single-stranded, linear
  The letter "N" represents the stem II region of an HH ribozyme.
uuaacaugcugaugangaaaacccauu

SEQ ID NO: 336 - DNA, 27 bp; single-stranded, linear
  The letter "N" represents the stem II region of an HH ribozyme.
guuaacaucugaugangaaaaacccau

SEQ ID NO: 337 - DNA, 27 bp; single-stranded, linear
  The letter "N" represents the stem II region of an HH ribozyme.
uccaaguucugaugangaaacaugaaa

SEQ ID NO: 338 - DNA, 27 bp; single-stranded, linear
  The letter "N" represents the stem II region of an HH ribozyme.
uuccaagucugaugangaaaacaugaa

SEQ ID NO: 339 - DNA, 27 bp; single-stranded, linear
  The letter "N" represents the stem II region of an HH ribozyme.
uuuuuucccugaugangaaaguuaaca

SEQ ID NO: 340 - DNA, 27 bp; single-stranded, linear
  The letter "N" represents the stem II region of an HH ribozyme.
cugugcaacugaugangaaacaguuuc

SEQ ID NO: 341 - DNA, 27 bp; single-stranded, linear
  The letter "N" represents the stem II region of an HH ribozyme.
aacugugccugaugangaaagacaguu

SEQ ID NO: 342 - DNA, 27 bp; single-stranded, linear
  The letter "N" represents the stem II region of an HH ribozyme.
aacuuguucugaugangaaacugugca

SEQ ID NO: 343 - DNA, 27 bp; single-stranded, linear
  The letter "N" represents the stem II region of an HH ribozyme.
gaacuugucugaugangaaaacugugc

SEQ ID NO: 344 - DNA, 27 bp; single-stranded, linear
  The letter "N" represents the stem II region of an HH ribozyme.
uguauaagcugaugangaaacuuguua

SEQ ID NO: 345 - DNA, 27 bp; single-stranded, linear
  The letter "N" represents the stem II region of an HH ribozyme.
cuguauaacugaugangaaaacuuguu

SEQ ID NO: 346 - DNA, 27 bp; single-stranded, linear
  The letter "N" represents the stem II region of an HH ribozyme.
cucuguaucugaugangaaagaacuug

SEQ ID NO: 347 - DNA, 27 bp; single-stranded, linear
  The letter "N" represents the stem II region of an HH ribozyme.
ucucuguacugaugangaaaagaacuu

SEQ ID NO: 348 - DNA, 27 bp; single-stranded, linear
  The letter "N" represents the stem II region of an HH ribozyme.
cgucucugcugaugangaaauaagaac

SEQ ID NO: 349 - DNA, 27 bp; single-stranded, linear
  The letter "N" represents the stem II region of an HH ribozyme.
auccaagucugaugangaaacgucucu

SEQ ID NO: 350 - DNA, 27 bp; single-stranded, linear
  The letter "N" represents the stem II region of an HH ribozyme.
aauccaagcugaugangaaaacgucuc

SEQ ID NO: 351 - DNA, 27 bp; single-stranded, linear
  The letter "N" represents the stem II region of an HH ribozyme.
uaaaaucccugaugangaaaguaacgu

SEQ ID NO: 352 - DNA, 27 bp; single-stranded, linear
  The letter "N" represents the stem II region of an HH ribozyme.
cgcaguaacugaugangaaauccaagu

SEQ ID NO: 353 - DNA, 27 bp; single-stranded, linear
  The letter "N" represents the stem II region of an HH ribozyme.
ccgcaguacugaugangaaaauccaag

SEQ ID NO: 354 - DNA, 27 bp; single-stranded, linear
  The letter "N" represents the stem II region of an HH ribozyme.
uccgcagucugaugangaaaaauccaa

SEQ ID NO: 355 - DNA, 27 bp; single-stranded, linear
  The letter "N" represents the stem II region of an HH ribozyme.
guccgcagcugaugangaaaaaaucca

SEQ ID NO: 356 - DNA, 27 bp; single-stranded, linear
  The letter "N" represents the stem II region of an HH ribozyme.
cuguuauucugaugangaaacuguccg

SEQ ID NO: 357 - DNA, 27 bp; single-stranded, linear
  The letter "N" represents the stem II region of an HH ribozyme.
ucuguuaucugaugangaaaacugucc

SEQ ID NO: 358 - DNA, 27 bp; single-stranded, linear
  The letter "N" represents the stem II region of an HH ribozyme.
uguucugucugaugangaaauuaacug

SEQ ID NO: 359 - DNA, 27 bp; single-stranded, linear
  The letter "N" represents the stem II region of an HH ribozyme.
uaauacugcugaugangaaagugcauu

SEQ ID NO: 360 - DNA, 27 bp; single-stranded, linear
  The letter "N" represents the stem II region of an HH ribozyme.
cuugcuaacugaugangaaacuguagu

SEQ ID NO: 361 - DNA, 27 bp; single-stranded, linear
  The letter "N" represents the stem II region of an HH ribozyme.
ugcuugcucugaugangaaauacugua

SEQ ID NO: 362 - DNA, 27 bp; single-stranded, linear
  The letter "N" represents the stem II region of an HH ribozyme.
uugcuugccugaugangaaaauacugu

SEQ ID NO: 363 - DNA, 27 bp; single-stranded, linear
  The letter "N" represents the stem II region of an HH ribozyme.
uccuuagucugaugangaaauggccau

SEQ ID NO: 364 - DNA, 27 bp; single-stranded, linear
  The letter "N" represents the stem II region of an HH ribozyme.
gugcuccucugaugangaaagugaugg

SEQ ID NO: 365 - DNA, 27 bp; single-stranded, linear
  The letter "N" represents the stem II region of an HH ribozyme.
gagugaugcugaugangaaagugcucc

SEQ ID NO: 366 - DNA, 27 bp; single-stranded, linear
  The letter "N" represents the stem II region of an HH ribozyme.
uuaagagucugaugangaaauggagug

SEQ ID NO: 367 - DNA, 27 bp; single-stranded, linear
  The letter "N" represents the stem II region of an HH ribozyme.
aagauuaacugaugangaaagugaugg

SEQ ID NO: 368 - DNA, 27 bp; single-stranded, linear
  The letter "N" represents the stem II region of an HH ribozyme.
guaagauucugaugangaaagagugau

SEQ ID NO: 369 - DNA, 27 bp; single-stranded, linear
  The letter "N" represents the stem II region of an HH ribozyme.
gguaagaucugaugangaaaagaguga

SEQ ID NO: 370 - DNA, 27 bp; single-stranded, linear
  The letter "N" represents the stem II region of an HH ribozyme.
gaugguaacugaugangaaauuaagag

SEQ ID NO: 371 - DNA, 27 bp; single-stranded, linear
  The letter "N" represents the stem II region of an HH ribozyme.
augauggucugaugangaaagauuaag

SEQ ID NO: 372 - DNA, 27 bp; single-stranded, linear
  The letter "N" represents the stem II region of an HH ribozyme.
caugauggcugaugangaaaagauuaa

SEQ ID NO: 373 - DNA, 27 bp; single-stranded, linear
  The letter "N" represents the stem II region of an HH ribozyme.
acauucaucugaugangaaaugguaag

SEQ ID NO: 374 - DNA, 27 bp; single-stranded, linear
  The letter "N" represents the stem II region of an HH ribozyme.
ugcagggacugaugangaaacauucau

SEQ ID NO: 375 - DNA, 27 bp; single-stranded, linear
  The letter "N" represents the stem II region of an HH ribozyme.
uugcagggcugaugangaaaacauuca

SEQ ID NO: 376 - DNA, 27 bp; single-stranded, linear
  The letter "N" represents the stem II region of an HH ribozyme.
cuugcaggcugaugangaaaaacauuc

SEQ ID NO: 377 - DNA, 27 bp; single-stranded, linear
  The letter "N" represents the stem II region of an HH ribozyme.
ggugccugcugaugangaaaucuugca

SEQ ID NO: 378 - DNA, 27 bp; single-stranded, linear
  The letter "N" represents the stem II region of an HH ribozyme.
aggugccucugaugangaaaaucuugc

SEQ ID NO: 379 - DNA, 27 bp; single-stranded, linear
  The letter "N" represents the stem II region of an HH ribozyme.
ugcaggcacugaugangaaaggugccu

SEQ ID NO: 380 - DNA, 27 bp; single-stranded, linear
  The letter "N" represents the stem II region of an HH ribozyme.
ccuguguacugaugangaaacauuccu

SEQ ID NO: 381 - DNA, 27 bp; single-stranded, linear
  The letter "N" represents the stem II region of an HH ribozyme.
ccccugugcugaugangaaauacauuc

SEQ ID NO: 382 - DNA, 27 bp; single-stranded, linear
  The letter "N" represents the stem II region of an HH ribozyme.
uucuggagcugaugangaaauuucuuc

SEQ ID NO: 383 - DNA, 27 bp; single-stranded, linear
  The letter "N" represents the stem II region of an HH ribozyme.
uucuucugcugaugangaaaggauuuc

SEQ ID NO: 384 - DNA, 27 bp; single-stranded, linear
  The letter "N" represents the stem II region of an HH ribozyme.
cugauugucugaugangaaauuucuuu

SEQ ID NO: 385 - DNA, 27 bp; single-stranded, linear
  The letter "N" represents the stem II region of an HH ribozyme.
ucugauugcugaugangaaaauuucuu

SEQ ID NO: 386 - DNA, 27 bp; single-stranded, linear
  The letter "N" represents the stem II region of an HH ribozyme.
ugaucucucugaugangaaauuguaau

SEQ ID NO: 387 - DNA, 27 bp; single-stranded, linear
  The letter "N" represents the stem II region of an HH ribozyme.
ugcuuccucugaugangaaaucucuga

SEQ ID NO: 388 - DNA, 27 bp; single-stranded, linear
  The letter "N" represents the stem II region of an HH ribozyme.
gcaggaggcugaugangaaauggugcu

SEQ ID NO: 389 - DNA, 27 bp; single-stranded, linear
  The letter "N" represents the stem II region of an HH ribozyme.
uuucgcagcugaugangaaagguaugg

SEQ ID NO: 390 - DNA, 27 bp; single-stranded, linear
  The letter "N" represents the stem II region of an HH ribozyme.
ugaucacucugaugangaaagguuucg

SEQ ID NO: 391 - DNA, 27 bp; single-stranded, linear
  The letter "N" represents the stem II region of an HH ribozyme.
cacugugucugaugangaaaucacuga

SEQ ID NO: 392 - DNA, 27 bp; single-stranded, linear
  The letter "N" represents the stem II region of an HH ribozyme.
gaacugcucugaugangaaauggccac

SEQ ID NO: 393 - DNA, 27 bp; single-stranded, linear
  The letter "N" represents the stem II region of an HH ribozyme.
agugguggcugaugangaaacugcuga

SEQ ID NO: 394 - DNA, 27 bp; single-stranded, linear
  The letter "N" represents the stem II region of an HH ribozyme.
aaguggugcugaugangaaaacugcug

SEQ ID NO: 395 - DNA, 27 bp; single-stranded, linear
  The letter "N" represents the stem II region of an HH ribozyme.
acagucuacugaugangaaaguggugg

SEQ ID NO: 396 - DNA, 27 bp; single-stranded, linear
  The letter "N" represents the stem II region of an HH ribozyme.
gacagucucugaugangaaaaguggug

SEQ ID NO: 397 - DNA, 27 bp; single-stranded, linear
  The letter "N" represents the stem II region of an HH ribozyme.
ugacaguccugaugangaaaaaguggu

SEQ ID NO: 398 - DNA, 27 bp; single-stranded, linear
  The letter "N" represents the stem II region of an HH ribozyme.
auuagcaucugaugangaaacagucua

SEQ ID NO: 399 - DNA, 27 bp; single-stranded, linear
  The letter "N" represents the stem II region of an HH ribozyme.
gacaccaucugaugangaaagcaugac

SEQ ID NO: 400 - DNA, 27 bp; single-stranded, linear
  The letter "N" represents the stem II region of an HH ribozyme.
ggcucgggcugaugangaaacaccauu

SEQ ID NO: 401 - DNA, 27 bp; single-stranded, linear
  The letter "N" represents the stem II region of an HH ribozyme.
agugaucucugaugangaaaggcucgg

SEQ ID NO: 402 - DNA, 27 bp; single-stranded, linear
  The letter "N" represents the stem II region of an HH ribozyme.
aaccaagucugaugangaaaucugagg

SEQ ID NO: 403 - DNA, 27 bp; single-stranded, linear
  The letter "N" represents the stem II region of an HH ribozyme.
uuuaaacccugaugangaaagugaucu

SEQ ID NO: 404 - DNA, 27 bp; single-stranded, linear
  The letter "N" represents the stem II region of an HH ribozyme.
uguuuuuacugaugangaaaccaagug

SEQ ID NO: 405 - DNA, 27 bp; single-stranded, linear
  The letter "N" represents the stem II region of an HH ribozyme.
uuguuuuucugaugangaaaaccaagu

SEQ ID NO: 406 - DNA, 27 bp; single-stranded, linear
  The letter "N" represents the stem II region of an HH ribozyme.
guuguuuucugaugangaaaaaccaag

SEQ ID NO: 407 - DNA, 27 bp; single-stranded, linear
  The letter "N" represents the stem II region of an HH ribozyme.
ucuuguugcugaugangaaauuuugug

SEQ ID NO: 408 - DNA, 27 bp; single-stranded, linear
  The letter "N" represents the stem II region of an HH ribozyme.
ccuaaaaucugaugangaaauuccagg

SEQ ID NO: 409 - DNA, 27 bp; single-stranded, linear
  The letter "N" represents the stem II region of an HH ribozyme.
uccuaaaacugaugangaaaauuccag

SEQ ID NO: 410 - DNA, 27 bp; single-stranded, linear
  The letter "N" represents the stem II region of an HH ribozyme.
gguccuaacugaugangaaauaauucc

SEQ ID NO: 411 - DNA, 27 bp; single-stranded, linear
  The letter "N" represents the stem II region of an HH ribozyme.
ugguccuacugaugangaaaauaauuc

SEQ ID NO: 412 - DNA, 27 bp; single-stranded, linear
  The letter "N" represents the stem II region of an HH ribozyme.
cugguccucugaugangaaaaauaauu

SEQ ID NO: 413 - DNA, 27 bp; single-stranded, linear
  The letter "N" represents the stem II region of an HH ribozyme.
ccuggucccugaugangaaaaaauaau

SEQ ID NO: 414 - DNA, 27 bp; single-stranded, linear
  The letter "N" represents the stem II region of an HH ribozyme.
uuucaauacugaugangaaacagcgug

SEQ ID NO: 415 - DNA, 27 bp; single-stranded, linear
  The letter "N" represents the stem II region of an HH ribozyme.
cuuucaaucugaugangaaaacagcgu

SEQ ID NO: 416 - DNA, 27 bp; single-stranded, linear
  The letter "N" represents the stem II region of an HH ribozyme.
ucuuucaacugaugangaaaaacagcg

SEQ ID NO: 417 - DNA, 27 bp; single-stranded, linear
  The letter "N" represents the stem II region of an HH ribozyme.
acucuuuccugaugangaaauaaacag

SEQ ID NO: 418 - DNA, 27 bp; single-stranded, linear
  The letter "N" represents the stem II region of an HH ribozyme.
ucuucugucugaugangaaacucuuuc

SEQ ID NO: 419 - DNA, 27 bp; single-stranded, linear
  The letter "N" represents the stem II region of an HH ribozyme.
cagugauacugaugangaaacaccuuc

SEQ ID NO: 420 - DNA, 27 bp; single-stranded, linear
  The letter "N" represents the stem II region of an HH ribozyme.
ugcagugacugaugangaaagacaccu

SEQ ID NO: 421 - DNA, 27 bp; single-stranded, linear
  The letter "N" represents the stem II region of an HH ribozyme.
uuugcagucugaugangaaauagacac

SEQ ID NO: 422 - DNA, 27 bp; single-stranded, linear
  The letter "N" represents the stem II region of an HH ribozyme.
uuuccacacugaugangaaagcccuuc

SEQ ID NO: 423 - DNA, 27 bp; single-stranded, linear
  The letter "N" represents the stem II region of an HH ribozyme.
guaugcugcugaugangaaacuuucca

SEQ ID NO: 424 - DNA, 27 bp; single-stranded, linear
  The letter "N" represents the stem II region of an HH ribozyme.
gguaugcucugaugangaaaacuuucc

SEQ ID NO: 425 - DNA, 27 bp; single-stranded, linear
  The letter "N" represents the stem II region of an HH ribozyme.
cagugaggcugaugangaaaugcugaa

SEQ ID NO: 426 - DNA, 27 bp; single-stranded, linear
  The letter "N" represents the stem II region of an HH ribozyme.
ugaacagucugaugangaaagguaugc

SEQ ID NO: 427 - DNA, 27 bp; single-stranded, linear
  The letter "N" represents the stem II region of an HH ribozyme.
guuccuugcugaugangaaacagugag

SEQ ID NO: 428 - DNA, 27 bp; single-stranded, linear
  The letter "N" represents the stem II region of an HH ribozyme.
gguuccuucugaugangaaaacaguga

SEQ ID NO: 429 - DNA, 27 bp; single-stranded, linear
  The letter "N" represents the stem II region of an HH ribozyme.
acuugucccugaugangaaagguuccu

SEQ ID NO: 430 - DNA, 27 bp; single-stranded, linear
  The letter "N" represents the stem II region of an HH ribozyme.
ccagauuacugaugangaaacuugucc

SEQ ID NO: 431 - DNA, 27 bp; single-stranded, linear
  The letter "N" represents the stem II region of an HH ribozyme.
cuccagaucugaugangaaagacuugu

SEQ ID NO: 432 - DNA, 27 bp; single-stranded, linear
  The letter "N" represents the stem II region of an HH ribozyme.
cagcuccacugaugangaaauuagacu

SEQ ID NO: 433 - DNA, 27 bp; single-stranded, linear
  The letter "N" represents the stem II region of an HH ribozyme.
guuagagucugaugangaaaucagcuc

SEQ ID NO: 434 - DNA, 27 bp; single-stranded, linear
  The letter "N" represents the stem II region of an HH ribozyme.
gcauguuacugaugangaaagugauca

SEQ ID NO: 435 - DNA, 27 bp; single-stranded, linear
  The letter "N" represents the stem II region of an HH ribozyme.
gugcaugucugaugangaaagagugau

SEQ ID NO: 436 - DNA, 27 bp; single-stranded, linear
  The letter "N" represents the stem II region of an HH ribozyme.
ccagaagacugaugangaaagucgcag

SEQ ID NO: 437 - DNA, 27 bp; single-stranded, linear
  The letter "N" represents the stem II region of an HH ribozyme.
agccagaacugaugangaaagagucgc

SEQ ID NO: 438 - DNA, 27 bp; single-stranded, linear
  The letter "N" represents the stem II region of an HH ribozyme.
ggagccagcugaugangaaagagaguc

SEQ ID NO: 439 - DNA, 27 bp; single-stranded, linear
  The letter "N" represents the stem II region of an HH ribozyme.
aggagccacugaugangaaaagagagu

SEQ ID NO: 440 - DNA, 27 bp; single-stranded, linear
  The letter "N" represents the stem II region of an HH ribozyme.
guuaauagcugaugangaaagccagaa

SEQ ID NO: 441 - DNA, 27 bp; single-stranded, linear
  The letter "N" represents the stem II region of an HH ribozyme.
aggguuaacugaugangaaaggagcca

SEQ ID NO: 442 - DNA, 27 bp; single-stranded, linear
  The letter "N" represents the stem II region of an HH ribozyme.
ggaggguucugaugangaaauaggagc

SEQ ID NO: 443 - DNA, 27 bp; single-stranded, linear
  The letter "N" represents the stem II region of an HH ribozyme.
aggagggucugaugangaaaauaggag

SEQ ID NO: 444 - DNA, 27 bp; single-stranded, linear
  The letter "N" represents the stem II region of an HH ribozyme.
cggauaagcugaugangaaaggguuaa

SEQ ID NO: 445 - DNA, 27 bp; single-stranded, linear
  The letter "N" represents the stem II region of an HH ribozyme.
uuucggaucugaugangaaaggagggu

SEQ ID NO: 446 - DNA, 27 bp; single-stranded, linear
  The letter "N" represents the stem II region of an HH ribozyme.
uuuucggacugaugangaaaaggaggg

SEQ ID NO: 447 - DNA, 27 bp; single-stranded, linear
  The letter "N" represents the stem II region of an HH ribozyme.
auuuuucgcugaugangaaauaaggag

SEQ ID NO: 448 - DNA, 27 bp; single-stranded, linear
  The letter "N" represents the stem II region of an HH ribozyme.
cagaagaacugaugangaaaccuuuuc

SEQ ID NO: 449 - DNA, 27 bp; single-stranded, linear
  The letter "N" represents the stem II region of an HH ribozyme.
uucagaagcugaugangaaagaccuuu

SEQ ID NO: 450 - DNA, 27 bp; single-stranded, linear
  The letter "N" represents the stem II region of an HH ribozyme.
uuucagaacugaugangaaaagaccuu

SEQ ID NO: 451 - DNA, 27 bp; single-stranded, linear
  The letter "N" represents the stem II region of an HH ribozyme.
uauuucagcugaugangaaagaagacc

SEQ ID NO: 452 - DNA, 27 bp; single-stranded, linear
  The letter "N" represents the stem II region of an HH ribozyme.
uuauuucacugaugangaaaagaagac

SEQ ID NO: 453 - DNA, 27 bp; single-stranded, linear
  The letter "N" represents the stem II region of an HH ribozyme.
ucagucuucugaugangaaauuucaga

SEQ ID NO: 454 - DNA, 27 bp; single-stranded, linear
  The letter "N" represents the stem II region of an HH ribozyme.
uugauaggcugaugangaaagucaguc

SEQ ID NO: 455 - DNA, 27 bp; single-stranded, linear
  The letter "N" represents the stem II region of an HH ribozyme.
auaauugacugaugangaaagguaguc

SEQ ID NO: 456 - DNA, 27 bp; single-stranded, linear
  The letter "N" represents the stem II region of an HH ribozyme.
uuauaauucugaugangaaauagguag

SEQ ID NO: 457 - DNA, 27 bp; single-stranded, linear
  The letter "N" represents the stem II region of an HH ribozyme.
uccauuaucugaugangaaauugauag

SEQ ID NO: 458 - DNA, 27 bp; single-stranded, linear
  The letter "N" represents the stem II region of an HH ribozyme.
guccauuacugaugangaaaauugaua

SEQ ID NO: 459 - DNA, 27 bp; single-stranded, linear
  The letter "N" represents the stem II region of an HH ribozyme.
ggguccaucugaugangaaauaauuga

SEQ ID NO: 460 - DNA, 27 bp; single-stranded, linear
  The letter "N" represents the stem II region of an HH ribozyme.
uccaaaggcugaugangaaacuucauc

SEQ ID NO: 461 - DNA, 27 bp; single-stranded, linear
  The letter "N" represents the stem II region of an HH ribozyme.
auccaaagcugaugangaaaacuucau

SEQ ID NO: 462 - DNA, 27 bp; single-stranded, linear
  The letter "N" represents the stem II region of an HH ribozyme.
cucauccacugaugangaaaggaacuu

SEQ ID NO: 463 - DNA, 27 bp; single-stranded, linear
  The letter "N" represents the stem II region of an HH ribozyme.
gcucaucccugaugangaaaaggaacu

SEQ ID NO: 464 - DNA, 27 bp; single-stranded, linear
  The letter "N" represents the stem II region of an HH ribozyme.
ucauaaggcugaugangaaagccgcuc

SEQ ID NO: 465 - DNA, 27 bp; single-stranded, linear
  The letter "N" represents the stem II region of an HH ribozyme.
ggcaucaucugaugangaaagggagcc

SEQ ID NO: 466 - DNA, 27 bp; single-stranded, linear
  The letter "N" represents the stem II region of an HH ribozyme.
uggcaucacugaugangaaaagggagc

SEQ ID NO: 467 - DNA, 27 bp; single-stranded, linear
  The letter "N" represents the stem II region of an HH ribozyme.
cccgggcacugaugangaaacucccac

SEQ ID NO: 468 - DNA, 27 bp; single-stranded, linear
  The letter "N" represents the stem II region of an HH ribozyme.
ucccgggccugaugangaaaacuccca

SEQ ID NO: 469 - DNA, 27 bp; single-stranded, linear
  The letter "N" represents the stem II region of an HH ribozyme.
cccaguuucugaugangaaagucucuc

SEQ ID NO: 470 - DNA, 27 bp; single-stranded, linear
  The letter "N" represents the stem II region of an HH ribozyme.
gcccaguucugaugangaaaagucucu

SEQ ID NO: 471 - DNA, 27 bp; single-stranded, linear
  The letter "N" represents the stem II region of an HH ribozyme.
uuccaagucugaugangaaauuugccc

SEQ ID NO: 472 - DNA, 27 bp; single-stranded, linear
  The letter "N" represents the stem II region of an HH ribozyme.
ccucuucccugaugangaaagugauuu

SEQ ID NO: 473 - DNA, 27 bp; single-stranded, linear
  The letter "N" represents the stem II region of an HH ribozyme.
uuuuccaacugaugangaaagccccuc

SEQ ID NO: 474 - DNA, 27 bp; single-stranded, linear
  The letter "N" represents the stem II region of an HH ribozyme.
cuuuuccacugaugangaaaagccccu

SEQ ID NO: 475 - DNA, 27 bp; single-stranded, linear
  The letter "N" represents the stem II region of an HH ribozyme.
acuuuucccugaugangaaaaagcccc

SEQ ID NO: 476 - DNA, 27 bp; single-stranded, linear
  The letter "N" represents the stem II region of an HH ribozyme.
gaugcuugcugaugangaaaccacuuu

SEQ ID NO: 477 - DNA, 27 bp; single-stranded, linear
  The letter "N" represents the stem II region of an HH ribozyme.
ugaugcuucugaugangaaaaccacuu

SEQ ID NO: 478 - DNA, 27 bp; single-stranded, linear
  The letter "N" represents the stem II region of an HH ribozyme.
caaaugcucugaugangaaaugcuuga

SEQ ID NO: 479 - DNA, 27 bp; single-stranded, linear
  The letter "N" represents the stem II region of an HH ribozyme.
uaaugccacugaugangaaaugcugau

SEQ ID NO: 480 - DNA, 27 bp; single-stranded, linear
  The letter "N" represents the stem II region of an HH ribozyme.
uuaaugcccugaugangaaaaugcuga

SEQ ID NO: 481 - DNA, 27 bp; single-stranded, linear
  The letter "N" represents the stem II region of an HH ribozyme.
gauuucuucugaugangaaaugccaaa

SEQ ID NO: 482 - DNA, 27 bp; single-stranded, linear
  The letter "N" represents the stem II region of an HH ribozyme.
ugauuucucugaugangaaaaugccaa

SEQ ID NO: 483 - DNA, 27 bp; single-stranded, linear
  The letter "N" represents the stem II region of an HH ribozyme.
acguaggucugaugangaaauuucuua

SEQ ID NO: 484 - DNA, 27 bp; single-stranded, linear
  The letter "N" represents the stem II region of an HH ribozyme.
ccggcacgcugaugangaaaggugauu

SEQ ID NO: 485 - DNA, 27 bp; single-stranded, linear
  The letter "N" represents the stem II region of an HH ribozyme.
gagcuuugcugaugangaaacucgcug

SEQ ID NO: 486 - DNA, 27 bp; single-stranded, linear
  The letter "N" represents the stem II region of an HH ribozyme.
agucaucacugaugangaaagcuuugu

SEQ ID NO: 487 - DNA, 27 bp; single-stranded, linear
  The letter "N" represents the stem II region of an HH ribozyme.
aagauuuucugaugangaaagcucagu

SEQ ID NO: 488 - DNA, 27 bp; single-stranded, linear
  The letter "N" represents the stem II region of an HH ribozyme.
ugggucaacugaugangaaauuuuuag

SEQ ID NO: 489 - DNA, 27 bp; single-stranded, linear
  The letter "N" represents the stem II region of an HH ribozyme.
uguggguccugaugangaaagauuuuu

SEQ ID NO: 490 - DNA, 27 bp; single-stranded, linear
  The letter "N" represents the stem II region of an HH ribozyme.
ugguggcccugaugangaaaugugggu

SEQ ID NO: 491 - DNA, 27 bp; single-stranded, linear
  The letter "N" represents the stem II region of an HH ribozyme.
cacguucacugaugangaaaugguggc

SEQ ID NO: 492 - DNA, 27 bp; single-stranded, linear
  The letter "N" represents the stem II region of an HH ribozyme.
agcagguucugaugangaaaccacguu

SEQ ID NO: 493 - DNA, 27 bp; single-stranded, linear
  The letter "N" represents the stem II region of an HH ribozyme.
cagcaggucugaugangaaaaccacgu

SEQ ID NO: 494 - DNA, 27 bp; single-stranded, linear
  The letter "N" represents the stem II region of an HH ribozyme.
caccaucacugaugangaaaggcccuc

SEQ ID NO: 495 - DNA, 27 bp; single-stranded, linear
  The letter "N" represents the stem II region of an HH ribozyme.
uauucaaccugaugangaaaucaccau

SEQ ID NO: 496 - DNA, 27 bp; single-stranded, linear
  The letter "N" represents the stem II region of an HH ribozyme.
caguauuccugaugangaaacaaucac

SEQ ID NO: 497 - DNA, 27 bp; single-stranded, linear
  The letter "N" represents the stem II region of an HH ribozyme.
auuugcagcugaugangaaauucaaca

SEQ ID NO: 498 - DNA, 27 bp; single-stranded, linear
  The letter "N" represents the stem II region of an HH ribozyme.
gauuuccacugaugangaaauuugcag

SEQ ID NO: 499 - DNA, 27 bp; single-stranded, linear
  The letter "N" represents the stem II region of an HH ribozyme.
guuggagacugaugangaaauuuccau

SEQ ID NO: 500 - DNA, 27 bp; single-stranded, linear
  The letter "N" represents the stem II region of an HH ribozyme.
uaguuggacugaugangaaagauuucc

SEQ ID NO: 501 - DNA, 27 bp; single-stranded, linear
  The letter "N" represents the stem II region of an HH ribozyme.
gguaguugcugaugangaaagagauuu

SEQ ID NO: 502 - DNA, 27 bp; single-stranded, linear
  The letter "N" represents the stem II region of an HH ribozyme.
ucuugaggcugaugangaaaguuggag

SEQ ID NO: 503 - DNA, 27 bp; single-stranded, linear
  The letter "N" represents the stem II region of an HH ribozyme.
uugcucuucugaugangaaagguaguu

SEQ ID NO: 504 - DNA, 27 bp; single-stranded, linear
  The letter "N" represents the stem II region of an HH ribozyme.
gaaaaaaucugaugangaaagucacgu

SEQ ID NO: 505 - DNA, 27 bp; single-stranded, linear
  The letter "N" represents the stem II region of an HH ribozyme.
agaaaaaacugaugangaaaagucacg

SEQ ID NO: 506 - DNA, 27 bp; single-stranded, linear
  The letter "N" represents the stem II region of an HH ribozyme.
ugagaaaacugaugangaaauaaguca

SEQ ID NO: 507 - DNA, 27 bp; single-stranded, linear
  The letter "N" represents the stem II region of an HH ribozyme.
uugagaaacugaugangaaaauaaguc

SEQ ID NO: 508 - DNA, 27 bp; single-stranded, linear
  The letter "N" represents the stem II region of an HH ribozyme.
guugagaacugaugangaaaaauaagu

SEQ ID NO: 509 - DNA, 27 bp; single-stranded, linear
  The letter "N" represents the stem II region of an HH ribozyme.
uguugagacugaugangaaaaaauaag

SEQ ID NO: 510 - DNA, 27 bp; single-stranded, linear
  The letter "N" represents the stem II region of an HH ribozyme.
uuguugagcugaugangaaaaaaauaa

SEQ ID NO: 511 - DNA, 27 bp; single-stranded, linear
  The letter "N" represents the stem II region of an HH ribozyme.
cuuguugacugaugangaaaaaaaaua

SEQ ID NO: 512 - DNA, 27 bp; single-stranded, linear
  The letter "N" represents the stem II region of an HH ribozyme.
uccuuguucugaugangaaagaaaaaa

SEQ ID NO: 513 - DNA, 27 bp; single-stranded, linear
  The letter "N" represents the stem II region of an HH ribozyme.
uccaugugcugaugangaaagugcugc

SEQ ID NO: 514 - DNA, 27 bp; single-stranded, linear
  The letter "N" represents the stem II region of an HH ribozyme.
uucuuucucugaugangaaaggcucca

SEQ ID NO: 515 - DNA, 27 bp; single-stranded, linear
  The letter "N" represents the stem II region of an HH ribozyme.
acgcuauccugaugangaaagucuugg

SEQ ID NO: 516 - DNA, 27 bp; single-stranded, linear
  The letter "N" represents the stem II region of an HH ribozyme.
ggugacgccugaugangaaaucuaguc

SEQ ID NO: 517 - DNA, 27 bp; single-stranded, linear
  The letter "N" represents the stem II region of an HH ribozyme.
cugcuggucugaugangaaacgcuauc

SEQ ID NO: 518 - DNA, 27 bp; single-stranded, linear
  The letter "N" represents the stem II region of an HH ribozyme.
agcucgcacugaugangaaagcuuucg

SEQ ID NO: 519 - DNA, 27 bp; single-stranded, linear
  The letter "N" represents the stem II region of an HH ribozyme.
gagcucgccugaugangaaaagcuuuc

SEQ ID NO: 520 - DNA, 27 bp; single-stranded, linear
  The letter "N" represents the stem II region of an HH ribozyme.
gaaagccgcugaugangaaagcucgca

SEQ ID NO: 521 - DNA, 27 bp; single-stranded, linear
  The letter "N" represents the stem II region of an HH ribozyme.
cuuccugacugaugangaaagccggag

SEQ ID NO: 522 - DNA, 27 bp; single-stranded, linear
  The letter "N" represents the stem II region of an HH ribozyme.
ucuuccugcugaugangaaaagccgga

SEQ ID NO: 523 - DNA, 27 bp; single-stranded, linear
  The letter "N" represents the stem II region of an HH ribozyme.
aucuuccucugaugangaaaaagccgg

SEQ ID NO: 524 - DNA, 27 bp; single-stranded, linear
  The letter "N" represents the stem II region of an HH ribozyme.
cagacuuucugaugangaaaucuuccu

SEQ ID NO: 525 - DNA, 27 bp; single-stranded, linear
  The letter "N" represents the stem II region of an HH ribozyme.
aucacucacugaugangaaacuuuuau

SEQ ID NO: 526 - DNA, 27 bp; single-stranded, linear
  The letter "N" represents the stem II region of an HH ribozyme.
ucuuccuccugaugangaaacaucacu

SEQ ID NO: 527 - DNA, 27 bp; single-stranded, linear
  The letter "N" represents the stem II region of an HH ribozyme.
accgucagcugaugangaaauccuccu

SEQ ID NO: 528 - DNA, 27 bp; single-stranded, linear
  The letter "N" represents the stem II region of an HH ribozyme.
aaccgucacugaugangaaaauccucc

SEQ ID NO: 529 - DNA, 27 bp; single-stranded, linear
  The letter "N" represents the stem II region of an HH ribozyme.
cuuguagacugaugangaaaccgucag

SEQ ID NO: 530 - DNA, 27 bp; single-stranded, linear
  The letter "N" represents the stem II region of an HH ribozyme.
ccuuguagcugaugangaaaaccguca

SEQ ID NO: 531 - DNA, 27 bp; single-stranded, linear
  The letter "N" represents the stem II region of an HH ribozyme.
uccuuguacugaugangaaaaaccguc

SEQ ID NO: 532 - DNA, 27 bp; single-stranded, linear
  The letter "N" represents the stem II region of an HH ribozyme.
gcuccuugcugaugangaaagaaaccg

SEQ ID NO: 533 - DNA, 27 bp; single-stranded, linear
  The letter "N" represents the stem II region of an HH ribozyme.
uccauagucugaugangaaaugggcuc

SEQ ID NO: 534 - DNA, 27 bp; single-stranded, linear
  The letter "N" represents the stem II region of an HH ribozyme.
aucuuccacugaugangaaagugaugg

SEQ ID NO: 535 - DNA, 27 bp; single-stranded, linear
  The letter "N" represents the stem II region of an HH ribozyme.
agaaaucacugaugangaaaucuucca

SEQ ID NO: 536 - DNA, 27 bp; single-stranded, linear
  The letter "N" represents the stem II region of an HH ribozyme.
cuguaagacugaugangaaaucagauc

SEQ ID NO: 537 - DNA, 27 bp; single-stranded, linear
  The letter "N" represents the stem II region of an HH ribozyme.
acuguaagcugaugangaaaaucagau

SEQ ID NO: 538 - DNA, 27 bp; single-stranded, linear
  The letter "N" represents the stem II region of an HH ribozyme.
aacuguaacugaugangaaaaaucaga

SEQ ID NO: 539 - DNA, 27 bp; single-stranded, linear
  The letter "N" represents the stem II region of an HH ribozyme.
aaaacugucugaugangaaagaaauca

SEQ ID NO: 540 - DNA, 27 bp; single-stranded, linear
  The letter "N" represents the stem II region of an HH ribozyme.
gaaaacugcugaugangaaaagaaauc

SEQ ID NO: 541 - DNA, 27 bp; single-stranded, linear
  The letter "N" represents the stem II region of an HH ribozyme.
cacuugaacugaugangaaacuguaag

SEQ ID NO: 542 - DNA, 27 bp; single-stranded, linear
  The letter "N" represents the stem II region of an HH ribozyme.
ccacuugacugaugangaaaacuguaa

SEQ ID NO: 543 - DNA, 27 bp; single-stranded, linear
  The letter "N" represents the stem II region of an HH ribozyme.
gccacuugcugaugangaaaaacugua

SEQ ID NO: 544 - DNA, 27 bp; single-stranded, linear
  The letter "N" represents the stem II region of an HH ribozyme.
ggccacuucugaugangaaaaaacugu

SEQ ID NO: 545 - DNA, 27 bp; single-stranded, linear
  The letter "N" represents the stem II region of an HH ribozyme.
aagacaggcugaugangaaacuccaug

SEQ ID NO: 546 - DNA, 27 bp; single-stranded, linear
  The letter "N" represents the stem II region of an HH ribozyme.
gaagacagcugaugangaaaacuccau

SEQ ID NO: 547 - DNA, 27 bp; single-stranded, linear
  The letter "N" represents the stem II region of an HH ribozyme.
uucuggaacugaugangaaacaggaac

SEQ ID NO: 548 - DNA, 27 bp; single-stranded, linear
  The letter "N" represents the stem II region of an HH ribozyme.
cuuucuggcugaugangaaagacagga

SEQ ID NO: 549 - DNA, 27 bp; single-stranded, linear
  The letter "N" represents the stem II region of an HH ribozyme.
acuuucugcugaugangaaaagacagg

SEQ ID NO: 550 - DNA, 27 bp; single-stranded, linear
  The letter "N" represents the stem II region of an HH ribozyme.
ucccgaugcugaugangaaaugcacuu

SEQ ID NO: 551 - DNA, 27 bp; single-stranded, linear
  The letter "N" represents the stem II region of an HH ribozyme.
gucccgaucugaugangaaaaugcacu

SEQ ID NO: 552 - DNA, 27 bp; single-stranded, linear
  The letter "N" represents the stem II region of an HH ribozyme.
cagguccccugaugangaaaugaaugc

SEQ ID NO: 553 - DNA, 27 bp; single-stranded, linear
  The letter "N" represents the stem II region of an HH ribozyme.
gauaaaagcugaugangaaauguuucu

SEQ ID NO: 554 - DNA, 27 bp; single-stranded, linear
  The letter "N" represents the stem II region of an HH ribozyme.
agauaaaacugaugangaaaauguuuc

SEQ ID NO: 555 - DNA, 27 bp; single-stranded, linear
  The letter "N" represents the stem II region of an HH ribozyme.
ucagauaacugaugangaaagaauguu

SEQ ID NO: 556 - DNA, 27 bp; single-stranded, linear
  The letter "N" represents the stem II region of an HH ribozyme.
cucagauacugaugangaaaagaaugu

SEQ ID NO: 557 - DNA, 27 bp; single-stranded, linear
  The letter "N" represents the stem II region of an HH ribozyme.
ucucagaucugaugangaaaaagaaug

SEQ ID NO: 558 - DNA, 27 bp; single-stranded, linear
  The letter "N" represents the stem II region of an HH ribozyme.
uucucagacugaugangaaaaaagaau

SEQ ID NO: 559 - DNA, 27 bp; single-stranded, linear
  The letter "N" represents the stem II region of an HH ribozyme.
uguucucacugaugangaaauaaaaga

SEQ ID NO: 560 - DNA, 27 bp; single-stranded, linear
  The letter "N" represents the stem II region of an HH ribozyme.
aaaucacacugaugangaaaucuucac

SEQ ID NO: 561 - DNA, 27 bp; single-stranded, linear
  The letter "N" represents the stem II region of an HH ribozyme.
aaaaucaccugaugangaaaaucuuca

SEQ ID NO: 562 - DNA, 27 bp; single-stranded, linear
  The letter "N" represents the stem II region of an HH ribozyme.
aaggccaacugaugangaaaucacaaa

SEQ ID NO: 563 - DNA, 27 bp; single-stranded, linear
  The letter "N" represents the stem II region of an HH ribozyme.
caaggccacugaugangaaaaucacaa

SEQ ID NO: 564 - DNA, 27 bp; single-stranded, linear
  The letter "N" represents the stem II region of an HH ribozyme.
gcaaggcccugaugangaaaaaucaca

SEQ ID NO: 565 - DNA, 27 bp; single-stranded, linear
  The letter "N" represents the stem II region of an HH ribozyme.
ucccgggccugaugangaaaggccaaa

SEQ ID NO: 566 - DNA, 27 bp; single-stranded, linear
  The letter "N" represents the stem II region of an HH ribozyme.
cuuauaaacugaugangaaaucccggg

SEQ ID NO: 567 - DNA, 27 bp; single-stranded, linear
  The letter "N" represents the stem II region of an HH ribozyme.
uucuuauacugaugangaaauaucccg

SEQ ID NO: 568 - DNA, 27 bp; single-stranded, linear
  The letter "N" represents the stem II region of an HH ribozyme.
guucuuaucugaugangaaaauauccc

SEQ ID NO: 569 - DNA, 27 bp; single-stranded, linear
  The letter "N" represents the stem II region of an HH ribozyme.
gguucuuacugaugangaaaaauaucc

SEQ ID NO: 570 - DNA, 27 bp; single-stranded, linear
  The letter "N" represents the stem II region of an HH ribozyme.
gggguucucugaugangaaauaaauau

SEQ ID NO: 571 - DNA, 27 bp; single-stranded, linear
  The letter "N" represents the stem II region of an HH ribozyme.
ucucacaucugaugangaaaucggggu

SEQ ID NO: 572 - DNA, 27 bp; single-stranded, linear
  The letter "N" represents the stem II region of an HH ribozyme.
uucucacacugaugangaaaaucgggg

SEQ ID NO: 573 - DNA, 27 bp; single-stranded, linear
  The letter "N" represents the stem II region of an HH ribozyme.
aagucgagcugaugangaaaucuccuu

SEQ ID NO: 574 - DNA, 27 bp; single-stranded, linear
  The letter "N" represents the stem II region of an HH ribozyme.
aggaaguccugaugangaaaguaucuc

SEQ ID NO: 575 - DNA, 27 bp; single-stranded, linear
  The letter "N" represents the stem II region of an HH ribozyme.
uucagaggcugaugangaaagucgagu

SEQ ID NO: 576 - DNA, 27 bp; single-stranded, linear
  The letter "N" represents the stem II region of an HH ribozyme.
uuucagagcugaugangaaaagucgag

SEQ ID NO: 577 - DNA, 27 bp; single-stranded, linear
  The letter "N" represents the stem II region of an HH ribozyme.
ccauuucacugaugangaaaggaaguc

SEQ ID NO: 578 - DNA, 27 bp; single-stranded, linear
  The letter "N" represents the stem II region of an HH ribozyme.
agauucggcugaugangaaagccaucc

SEQ ID NO: 579 - DNA, 27 bp; single-stranded, linear
  The letter "N" represents the stem II region of an HH ribozyme.
caaagauacugaugangaaauucggga

SEQ ID NO: 580 - DNA, 27 bp; single-stranded, linear
  The letter "N" represents the stem II region of an HH ribozyme.
gucaaagacugaugangaaagauucgg

SEQ ID NO: 581 - DNA, 27 bp; single-stranded, linear
  The letter "N" represents the stem II region of an HH ribozyme.
uugucaaacugaugangaaauagauuc

SEQ ID NO: 582 - DNA, 27 bp; single-stranded, linear
  The letter "N" represents the stem II region of an HH ribozyme.
uuuugucacugaugangaaagauagau

SEQ ID NO: 583 - DNA, 27 bp; single-stranded, linear
  The letter "N" represents the stem II region of an HH ribozyme.
auuuuguccugaugangaaaagauaga

SEQ ID NO: 584 - DNA, 27 bp; single-stranded, linear
  The letter "N" represents the stem II region of an HH ribozyme.
gugcuguacugaugangaaauuuuguc

SEQ ID NO: 585 - DNA, 27 bp; single-stranded, linear
  The letter "N" represents the stem II region of an HH ribozyme.
uggugcugcugaugangaaagauuuug

SEQ ID NO: 586 - DNA, 27 bp; single-stranded, linear
  The letter "N" represents the stem II region of an HH ribozyme.
cuccguaacugaugangaaaccacacg

SEQ ID NO: 587 - DNA, 27 bp; single-stranded, linear
  The letter "N" represents the stem II region of an HH ribozyme.
uacuccgucugaugangaaagaccaca

SEQ ID NO: 588 - DNA, 27 bp; single-stranded, linear
  The letter "N" represents the stem II region of an HH ribozyme.
auacuccgcugaugangaaaagaccac

SEQ ID NO: 589 - DNA, 27 bp; single-stranded, linear
  The letter "N" represents the stem II region of an HH ribozyme.
cacagcaacugaugangaaacuccgua

SEQ ID NO: 590 - DNA, 27 bp; single-stranded, linear
  The letter "N" represents the stem II region of an HH ribozyme.
cccacagccugaugangaaauacuccg

SEQ ID NO: 591 - DNA, 27 bp; single-stranded, linear
  The letter "N" represents the stem II region of an HH ribozyme.
aaggagaacugaugangaaauuuccca

SEQ ID NO: 592 - DNA, 27 bp; single-stranded, linear
  The letter "N" represents the stem II region of an HH ribozyme.
cuaaggagcugaugangaaagauuucc

SEQ ID NO: 593 - DNA, 27 bp; single-stranded, linear
  The letter "N" represents the stem II region of an HH ribozyme.
ccuaaggacugaugangaaaagauuuc

SEQ ID NO: 594 - DNA, 27 bp; single-stranded, linear
  The letter "N" represents the stem II region of an HH ribozyme.
caccuaagcugaugangaaagaagauu

SEQ ID NO: 595 - DNA, 27 bp; single-stranded, linear
  The letter "N" represents the stem II region of an HH ribozyme.
acccaccucugaugangaaaggagaag

SEQ ID NO: 596 - DNA, 27 bp; single-stranded, linear
  The letter "N" represents the stem II region of an HH ribozyme.
gacccacccugaugangaaaaggagaa

SEQ ID NO: 597 - DNA, 27 bp; single-stranded, linear
  The letter "N" represents the stem II region of an HH ribozyme.
gguauggacugaugangaaacccaccu

SEQ ID NO: 598 - DNA, 27 bp; single-stranded, linear
  The letter "N" represents the stem II region of an HH ribozyme.
uggguaugcugaugangaaagacccac

SEQ ID NO: 599 - DNA, 27 bp; single-stranded, linear
  The letter "N" represents the stem II region of an HH ribozyme.
cuccugggcugaugangaaauggagac

SEQ ID NO: 600 - DNA, 27 bp; single-stranded, linear
  The letter "N" represents the stem II region of an HH ribozyme.
uccauuugcugaugangaaacuccugg

SEQ ID NO: 601 - DNA, 27 bp; single-stranded, linear
  The letter "N" represents the stem II region of an HH ribozyme.
gacugcaacugaugangaaaguccuca

SEQ ID NO: 602 - DNA, 27 bp; single-stranded, linear
  The letter "N" represents the stem II region of an HH ribozyme.
cgacugcacugaugangaaaaguccuc

SEQ ID NO: 603 - DNA, 27 bp; single-stranded, linear
  The letter "N" represents the stem II region of an HH ribozyme.
gcgacugccugaugangaaaaaguccu

SEQ ID NO: 604 - DNA, 27 bp; single-stranded, linear
  The letter "N" represents the stem II region of an HH ribozyme.
ccucaggccugaugangaaacugcaaa

SEQ ID NO: 605 - DNA, 27 bp; single-stranded, linear
  The letter "N" represents the stem II region of an HH ribozyme.
guacucagcugaugangaaagcucuca

SEQ ID NO: 606 - DNA, 27 bp; single-stranded, linear
  The letter "N" represents the stem II region of an HH ribozyme.
gaguagagcugaugangaaacucagga

SEQ ID NO: 607 - DNA, 27 bp; single-stranded, linear
  The letter "N" represents the stem II region of an HH ribozyme.
caggaguacugaugangaaaguacuca

SEQ ID NO: 608 - DNA, 27 bp; single-stranded, linear
  The letter "N" represents the stem II region of an HH ribozyme.
uucaggagcugaugangaaagaguacu

SEQ ID NO: 609 - DNA, 27 bp; single-stranded, linear
  The letter "N" represents the stem II region of an HH ribozyme.
gauuucagcugaugangaaaguagagu

SEQ ID NO: 610 - DNA, 27 bp; single-stranded, linear
  The letter "N" represents the stem II region of an HH ribozyme.
aucugauacugaugangaaauuucagg

SEQ ID NO: 611 - DNA, 27 bp; single-stranded, linear
  The letter "N" represents the stem II region of an HH ribozyme.
ugaucugacugaugangaaagauuuca

SEQ ID NO: 612 - DNA, 27 bp; single-stranded, linear
  The letter "N" represents the stem II region of an HH ribozyme.
caugaucucugaugangaaauagauuu

SEQ ID NO: 613 - DNA, 27 bp; single-stranded, linear
  The letter "N" represents the stem II region of an HH ribozyme.
uccagcaucugaugangaaaucugaua

SEQ ID NO: 614 - DNA, 27 bp; single-stranded, linear
  The letter "N" represents the stem II region of an HH ribozyme.
guucugcacugaugangaaaucuuggc

SEQ ID NO: 615 - DNA, 27 bp; single-stranded, linear
  The letter "N" represents the stem II region of an HH ribozyme.
aguucugccugaugangaaaaucuugg

SEQ ID NO: 616 - DNA, 27 bp; single-stranded, linear
  The letter "N" represents the stem II region of an HH ribozyme.
uuuuccaccugaugangaaaguucugc

SEQ ID NO: 617 - DNA, 27 bp; single-stranded, linear
  The letter "N" represents the stem II region of an HH ribozyme.
aaaucacccugaugangaaaguuuuuc

SEQ ID NO: 618 - DNA, 27 bp; single-stranded, linear
  The letter "N" represents the stem II region of an HH ribozyme.
uugaagcacugaugangaaaucaccua

SEQ ID NO: 619 - DNA, 27 bp; single-stranded, linear
  The letter "N" represents the stem II region of an HH ribozyme.
cuugaagccugaugangaaaaucaccu

SEQ ID NO: 620 - DNA, 27 bp; single-stranded, linear
  The letter "N" represents the stem II region of an HH ribozyme.
uuugcuugcugaugangaaagcaaauc

SEQ ID NO: 621 - DNA, 27 bp; single-stranded, linear
  The letter "N" represents the stem II region of an HH ribozyme.
auuugcuucugaugangaaaagcaaau

SEQ ID NO: 622 - DNA, 27 bp; single-stranded, linear
  The letter "N" represents the stem II region of an HH ribozyme.
uccuguugcugaugangaaacauuugc

SEQ ID NO: 623 - DNA, 27 bp; single-stranded, linear
  The letter "N" represents the stem II region of an HH ribozyme.
guagucuucugaugangaaaccauccu

SEQ ID NO: 624 - DNA, 27 bp; single-stranded, linear
  The letter "N" represents the stem II region of an HH ribozyme.
uugggaugcugaugangaaagucuuua

SEQ ID NO: 625 - DNA, 27 bp; single-stranded, linear
  The letter "N" represents the stem II region of an HH ribozyme.
uugauuggcugaugangaaauguaguc

SEQ ID NO: 626 - DNA, 27 bp; single-stranded, linear
  The letter "N" represents the stem II region of an HH ribozyme.
auggcauucugaugangaaauugggau

SEQ ID NO: 627 - DNA, 27 bp; single-stranded, linear
  The letter "N" represents the stem II region of an HH ribozyme.
ccugucagcugaugangaaauggcauu

SEQ ID NO: 628 - DNA, 27 bp; single-stranded, linear
  The letter "N" represents the stem II region of an HH ribozyme.
aaacccaccugaugangaaauuuccug

SEQ ID NO: 629 - DNA, 27 bp; single-stranded, linear
  The letter "N" represents the stem II region of an HH ribozyme.
aguauguacugaugangaaacccacua

SEQ ID NO: 630 - DNA, 27 bp; single-stranded, linear
  The letter "N" represents the stem II region of an HH ribozyme.
gaguaugucugaugangaaaacccacu

SEQ ID NO: 631 - DNA, 27 bp; single-stranded, linear
  The letter "N" represents the stem II region of an HH ribozyme.
ugaguaugcugaugangaaaaacccac

SEQ ID NO: 632 - DNA, 27 bp; single-stranded, linear
  The letter "N" represents the stem II region of an HH ribozyme.
gaguugagcugaugangaaauguaaac

SEQ ID NO: 633 - DNA, 27 bp; single-stranded, linear
  The letter "N" represents the stem II region of an HH ribozyme.
caggaguucugaugangaaaguaugua

SEQ ID NO: 634 - DNA, 27 bp; single-stranded, linear
  The letter "N" represents the stem II region of an HH ribozyme.
gaaggcagcugaugangaaaguugagu

SEQ ID NO: 635 - DNA, 27 bp; single-stranded, linear
  The letter "N" represents the stem II region of an HH ribozyme.
ccucagagcugaugangaaaggcagga

SEQ ID NO: 636 - DNA, 27 bp; single-stranded, linear
  The letter "N" represents the stem II region of an HH ribozyme.
uccucagacugaugangaaaaggcagg

SEQ ID NO: 637 - DNA, 27 bp; single-stranded, linear
  The letter "N" represents the stem II region of an HH ribozyme.
aguccucacugaugangaaagaaggca

SEQ ID NO: 638 - DNA, 27 bp; single-stranded, linear
  The letter "N" represents the stem II region of an HH ribozyme.
ccuugaagcugaugangaaaguccuca

SEQ ID NO: 639 - DNA, 27 bp; single-stranded, linear
  The letter "N" represents the stem II region of an HH ribozyme.
uccuugaacugaugangaaaaguccuc

SEQ ID NO: 640 - DNA, 27 bp; single-stranded, linear
  The letter "N" represents the stem II region of an HH ribozyme.
uuuccuugcugaugangaaagaagucc

SEQ ID NO: 641 - DNA, 27 bp; single-stranded, linear
  The letter "N" represents the stem II region of an HH ribozyme.
cuuuccuucugaugangaaaagaaguc

SEQ ID NO: 642 - DNA, 27 bp; single-stranded, linear
  The letter "N" represents the stem II region of an HH ribozyme.
agcugaaacugaugangaaacuuuccu

SEQ ID NO: 643 - DNA, 27 bp; single-stranded, linear
  The letter "N" represents the stem II region of an HH ribozyme.
ggagcugacugaugangaaauacuuuc

SEQ ID NO: 644 - DNA, 27 bp; single-stranded, linear
  The letter "N" represents the stem II region of an HH ribozyme.
cggagcugcugaugangaaaauacuuu

SEQ ID NO: 645 - DNA, 27 bp; single-stranded, linear
  The letter "N" represents the stem II region of an HH ribozyme.
ucggagcucugaugangaaaaauacuu

SEQ ID NO: 646 - DNA, 27 bp; single-stranded, linear
  The letter "N" represents the stem II region of an HH ribozyme.
aaacuucgcugaugangaaagcugaaa

SEQ ID NO: 647 - DNA, 27 bp; single-stranded, linear
  The letter "N" represents the stem II region of an HH ribozyme.
cugaauuacugaugangaaacuucgga

SEQ ID NO: 648 - DNA, 27 bp; single-stranded, linear
  The letter "N" represents the stem II region of an HH ribozyme.
ccugaauucugaugangaaaacuucgg

SEQ ID NO: 649 - DNA, 27 bp; single-stranded, linear
  The letter "N" represents the stem II region of an HH ribozyme.
uccugaaucugaugangaaaaacuucg

SEQ ID NO: 650 - DNA, 27 bp; single-stranded, linear
  The letter "N" represents the stem II region of an HH ribozyme.
gcuuccugcugaugangaaauuaaacu

SEQ ID NO: 651 - DNA, 27 bp; single-stranded, linear
  The letter "N" represents the stem II region of an HH ribozyme.
agcuuccucugaugangaaaauuaaac

SEQ ID NO: 652 - DNA, 27 bp; single-stranded, linear
  The letter "N" represents the stem II region of an HH ribozyme.
caucaucacugaugangaaagcuuccu

SEQ ID NO: 653 - DNA, 27 bp; single-stranded, linear
  The letter "N" represents the stem II region of an HH ribozyme.
acauaucucugaugangaaacaucauc

SEQ ID NO: 654 - DNA, 27 bp; single-stranded, linear
  The letter "N" represents the stem II region of an HH ribozyme.
cauuuacacugaugangaaaucugaca

SEQ ID NO: 655 - DNA, 27 bp; single-stranded, linear
  The letter "N" represents the stem II region of an HH ribozyme.
aaagcauucugaugangaaacauaucu

SEQ ID NO: 656 - DNA, 27 bp; single-stranded, linear
  The letter "N" represents the stem II region of an HH ribozyme.
gaacuugacugaugangaaagcauuua

SEQ ID NO: 657 - DNA, 27 bp; single-stranded, linear
  The letter "N" represents the stem II region of an HH ribozyme.
ugaacuugcugaugangaaaagcauuu

SEQ ID NO: 658 - DNA, 27 bp; single-stranded, linear
  The letter "N" represents the stem II region of an HH ribozyme.
augaacuucugaugangaaaaagcauu

SEQ ID NO: 659 - DNA, 27 bp; single-stranded, linear
  The letter "N" represents the stem II region of an HH ribozyme.
ggcucaugcugaugangaaacuugaaa

SEQ ID NO: 660 - DNA, 27 bp; single-stranded, linear
  The letter "N" represents the stem II region of an HH ribozyme.
aggcucaucugaugangaaaacuugaa

SEQ ID NO: 661 - DNA, 27 bp; single-stranded, linear
  The letter "N" represents the stem II region of an HH ribozyme.
aagguuuucugaugangaaauucuuuc

SEQ ID NO: 662 - DNA, 27 bp; single-stranded, linear
  The letter "N" represents the stem II region of an HH ribozyme.
guucuucacugaugangaaagguuuug

SEQ ID NO: 663 - DNA, 27 bp; single-stranded, linear
  The letter "N" represents the stem II region of an HH ribozyme.
aguucuuccugaugangaaaagguuuu

SEQ ID NO: 664 - DNA, 27 bp; single-stranded, linear
  The letter "N" represents the stem II region of an HH ribozyme.
uucgguaacugaugangaaaguucuuc

SEQ ID NO: 665 - DNA, 27 bp; single-stranded, linear
  The letter "N" represents the stem II region of an HH ribozyme.
auucgguacugaugangaaaaguucuu

SEQ ID NO: 666 - DNA, 27 bp; single-stranded, linear
  The letter "N" represents the stem II region of an HH ribozyme.
cauucggucugaugangaaaaaguucu

SEQ ID NO: 667 - DNA, 27 bp; single-stranded, linear
  The letter "N" represents the stem II region of an HH ribozyme.
gcauucggcugaugangaaaaaaguuc

SEQ ID NO: 668 - DNA, 27 bp; single-stranded, linear
  The letter "N" represents the stem II region of an HH ribozyme.
caaacaugcugaugangaaagguggca

SEQ ID NO: 669 - DNA, 27 bp; single-stranded, linear
  The letter "N" represents the stem II region of an HH ribozyme.
agucaucacugaugangaaacauggag

SEQ ID NO: 670 - DNA, 27 bp; single-stranded, linear
  The letter "N" represents the stem II region of an HH ribozyme.
uagucauccugaugangaaaacaugga

SEQ ID NO: 671 - DNA, 27 bp; single-stranded, linear
  The letter "N" represents the stem II region of an HH ribozyme.
cgcccuggcugaugangaaagucauca

SEQ ID NO: 672 - DNA, 27 bp; single-stranded, linear
  The letter "N" represents the stem II region of an HH ribozyme.
ggccaacacugaugangaaagugcugc

SEQ ID NO: 673 - DNA, 27 bp; single-stranded, linear
  The letter "N" represents the stem II region of an HH ribozyme.
gagaggcccugaugangaaacagagug

SEQ ID NO: 674 - DNA, 27 bp; single-stranded, linear
  The letter "N" represents the stem II region of an HH ribozyme.
gcaugggacugaugangaaaggccaac

SEQ ID NO: 675 - DNA, 27 bp; single-stranded, linear
  The letter "N" represents the stem II region of an HH ribozyme.
cagcauggcugaugangaaagaggcca

SEQ ID NO: 676 - DNA, 27 bp; single-stranded, linear
  The letter "N" represents the stem II region of an HH ribozyme.
uccaggugcugaugangaaagcgcuuc

SEQ ID NO: 677 - DNA, 27 bp; single-stranded, linear
  The letter "N" represents the stem II region of an HH ribozyme.
guccaggucugaugangaaaagcgcuu

SEQ ID NO: 678 - DNA, 27 bp; single-stranded, linear
  The letter "N" represents the stem II region of an HH ribozyme.
ucuugagccugaugangaaaggccuug

SEQ ID NO: 679 - DNA, 27 bp; single-stranded, linear
  The letter "N" represents the stem II region of an HH ribozyme.
ucaaucuucugaugangaaagcgaggc

SEQ ID NO: 680 - DNA, 27 bp; single-stranded, linear
  The letter "N" represents the stem II region of an HH ribozyme.
cucaaguccugaugangaaaucuugag

SEQ ID NO: 681 - DNA, 27 bp; single-stranded, linear
  The letter "N" represents the stem II region of an HH ribozyme.
uuacucuccugaugangaaagucaauc

SEQ ID NO: 682 - DNA, 27 bp; single-stranded, linear
  The letter "N" represents the stem II region of an HH ribozyme.
uuacuggucugaugangaaacucucaa

SEQ ID NO: 683 - DNA, 27 bp; single-stranded, linear
  The letter "N" represents the stem II region of an HH ribozyme.
cuuacuuucugaugangaaacugguua

SEQ ID NO: 684 - DNA, 27 bp; single-stranded, linear
  The letter "N" represents the stem II region of an HH ribozyme.
cgacuccucugaugangaaacuuuuac

SEQ ID NO: 685 - DNA, 27 bp; single-stranded, linear
  The letter "N" represents the stem II region of an HH ribozyme.
acagcccccugaugangaaacuccuua

SEQ ID NO: 686 - DNA, 27 bp; single-stranded, linear
  The letter "N" represents the stem II region of an HH ribozyme.
ugacaucacugaugangaaacagcccc

SEQ ID NO: 687 - DNA, 27 bp; single-stranded, linear
  The letter "N" represents the stem II region of an HH ribozyme.
ggccugcucugaugangaaacaucaga

SEQ ID NO: 688 - DNA, 27 bp; single-stranded, linear
  The letter "N" represents the stem II region of an HH ribozyme.
auggcagacugaugangaaacugggcc

SEQ ID NO: 689 - DNA, 27 bp; single-stranded, linear
  The letter "N" represents the stem II region of an HH ribozyme.
aauggcagcugaugangaaaacugggc

SEQ ID NO: 690 - DNA, 27 bp; single-stranded, linear
  The letter "N" represents the stem II region of an HH ribozyme.
gaauggcacugaugangaaaaacuggg

SEQ ID NO: 691 - DNA, 27 bp; single-stranded, linear
  The letter "N" represents the stem II region of an HH ribozyme.
acagcuggcugaugangaaauggcaga

SEQ ID NO: 692 - DNA, 27 bp; single-stranded, linear
  The letter "N" represents the stem II region of an HH ribozyme.
cacagcugcugaugangaaaauggcag

SEQ ID NO: 693 - DNA, 27 bp; single-stranded, linear
  The letter "N" represents the stem II region of an HH ribozyme.
ccuucgcucugaugangaaacgugccc

SEQ ID NO: 694 - DNA, 27 bp; single-stranded, linear
  The letter "N" represents the stem II region of an HH ribozyme.
cguaggugcugaugangaaaccugcgc

SEQ ID NO: 695 - DNA, 27 bp; single-stranded, linear
  The letter "N" represents the stem II region of an HH ribozyme.
ucguaggucugaugangaaaaccugcg

SEQ ID NO: 696 - DNA, 27 bp; single-stranded, linear
  The letter "N" represents the stem II region of an HH ribozyme.
cguggucgcugaugangaaaggugaac

SEQ ID NO: 697 - DNA, 27 bp; single-stranded, linear
  The letter "N" represents the stem II region of an HH ribozyme.
cagcacgccugaugangaaauuuuccu

SEQ ID NO: 698 - DNA, 27 bp; single-stranded, linear
  The letter "N" represents the stem II region of an HH ribozyme.
ggggcgggcugaugangaaagcagcac

SEQ ID NO: 699 - DNA, 27 bp; single-stranded, linear
  The letter "N" represents the stem II region of an HH ribozyme.
ccgaguugcugaugangaaagucuggg

SEQ ID NO: 700 - DNA, 27 bp; single-stranded, linear
  The letter "N" represents the stem II region of an HH ribozyme.
ggaccacccugaugangaaaguuguag

SEQ ID NO: 701 - DNA, 27 bp; single-stranded, linear
  The letter "N" represents the stem II region of an HH ribozyme.
gaguacagcugaugangaaaccaccga

SEQ ID NO: 702 - DNA, 27 bp; single-stranded, linear
  The letter "N" represents the stem II region of an HH ribozyme.
ggguggagcugaugangaaacaggacc

SEQ ID NO: 703 - DNA, 27 bp; single-stranded, linear
  The letter "N" represents the stem II region of an HH ribozyme.
guggggugcugaugangaaaguacagg

SEQ ID NO: 704 - DNA, 27 bp; single-stranded, linear
  The letter "N" represents the stem II region of an HH ribozyme.
aaacucuacugaugangaaaugggugg

SEQ ID NO: 705 - DNA, 27 bp; single-stranded, linear
  The letter "N" represents the stem II region of an HH ribozyme.
ucaaacuccugaugangaaagaugggu

SEQ ID NO: 706 - DNA, 27 bp; single-stranded, linear
  The letter "N" represents the stem II region of an HH ribozyme.
ucgugucacugaugangaaacucuaga

SEQ ID NO: 707 - DNA, 27 bp; single-stranded, linear
  The letter "N" represents the stem II region of an HH ribozyme.
uucguguccugaugangaaaacucuag

SEQ ID NO: 708 - DNA, 27 bp; single-stranded, linear
  The letter "N" represents the stem II region of an HH ribozyme.
cuagaaaucugaugangaaaggcuucg

SEQ ID NO: 709 - DNA, 27 bp; single-stranded, linear
  The letter "N" represents the stem II region of an HH ribozyme.
ucuagaaacugaugangaaaaggcuuc

SEQ ID NO: 710 - DNA, 27 bp; single-stranded, linear
  The letter "N" represents the stem II region of an HH ribozyme.
cuucuagacugaugangaaauaaggcu

SEQ ID NO: 711 - DNA, 27 bp; single-stranded, linear
  The letter "N" represents the stem II region of an HH ribozyme.
gcuucuagcugaugangaaaauaaggc

SEQ ID NO: 712 - DNA, 27 bp; single-stranded, linear
  The letter "N" represents the stem II region of an HH ribozyme.
ugcuucuacugaugangaaaaauaagg

SEQ ID NO: 713 - DNA, 27 bp; single-stranded, linear
  The letter "N" represents the stem II region of an HH ribozyme.
ugugcuuccugaugangaaagaaauaa

SEQ ID NO: 714 - DNA, 27 bp; single-stranded, linear
  The letter "N" represents the stem II region of an HH ribozyme.
gguauaaacugaugangaaacacaugu

SEQ ID NO: 715 - DNA, 27 bp; single-stranded, linear
  The letter "N" represents the stem II region of an HH ribozyme.
gggguauacugaugangaaauacacau

SEQ ID NO: 716 - DNA, 27 bp; single-stranded, linear
  The letter "N" represents the stem II region of an HH ribozyme.
ggggguaucugaugangaaaauacaca

SEQ ID NO: 717 - DNA, 27 bp; single-stranded, linear
  The letter "N" represents the stem II region of an HH ribozyme.
uggggguacugaugangaaaaauacac

SEQ ID NO: 718 - DNA, 27 bp; single-stranded, linear
  The letter "N" represents the stem II region of an HH ribozyme.
ccugggggcugaugangaaauaaauac

SEQ ID NO: 719 - DNA, 27 bp; single-stranded, linear
  The letter "N" represents the stem II region of an HH ribozyme.
gcaaaagccugaugangaaaguuuccu

SEQ ID NO: 720 - DNA, 27 bp; single-stranded, linear
  The letter "N" represents the stem II region of an HH ribozyme.
acuggcaacugaugangaaagcuaguu

SEQ ID NO: 721 - DNA, 27 bp; single-stranded, linear
  The letter "N" represents the stem II region of an HH ribozyme.
uacuggcacugaugangaaaagcuagu

SEQ ID NO: 722 - DNA, 27 bp; single-stranded, linear
  The letter "N" represents the stem II region of an HH ribozyme.
auacuggccugaugangaaaaagcuag

SEQ ID NO: 723 - DNA, 27 bp; single-stranded, linear
  The letter "N" represents the stem II region of an HH ribozyme.
augcauaacugaugangaaacuggcaa

SEQ ID NO: 724 - DNA, 27 bp; single-stranded, linear
  The letter "N" represents the stem II region of an HH ribozyme.
auaugcaucugaugangaaauacuggc

SEQ ID NO: 725 - DNA, 27 bp; single-stranded, linear
  The letter "N" represents the stem II region of an HH ribozyme.
uauaugcacugaugangaaaauacugg

SEQ ID NO: 726 - DNA, 27 bp; single-stranded, linear
  The letter "N" represents the stem II region of an HH ribozyme.
aacuuauacugaugangaaaugcauaa

SEQ ID NO: 727 - DNA, 27 bp; single-stranded, linear
  The letter "N" represents the stem II region of an HH ribozyme.
uaaacuuacugaugangaaauaugcau

SEQ ID NO: 728 - DNA, 27 bp; single-stranded, linear
  The letter "N" represents the stem II region of an HH ribozyme.
uguaaacucugaugangaaauauaugc

SEQ ID NO: 729 - DNA, 27 bp; single-stranded, linear
  The letter "N" represents the stem II region of an HH ribozyme.
aagguguacugaugangaaacuuauau

SEQ ID NO: 730 - DNA, 27 bp; single-stranded, linear
  The letter "N" represents the stem II region of an HH ribozyme.
aaaggugucugaugangaaaacuuaua

SEQ ID NO: 731 - DNA, 27 bp; single-stranded, linear
  The letter "N" represents the stem II region of an HH ribozyme.
uaaaggugcugaugangaaaaacuuau

SEQ ID NO: 732 - DNA, 27 bp; single-stranded, linear
  The letter "N" represents the stem II region of an HH ribozyme.
gaaagauacugaugangaaagguguaa

SEQ ID NO: 733 - DNA, 27 bp; single-stranded, linear
  The letter "N" represents the stem II region of an HH ribozyme.
ggaaagaucugaugangaaaaggugua

SEQ ID NO: 734 - DNA, 27 bp; single-stranded, linear
  The letter "N" represents the stem II region of an HH ribozyme.
uggaaagacugaugangaaaaaggugu

SEQ ID NO: 735 - DNA, 27 bp; single-stranded, linear
  The letter "N" represents the stem II region of an HH ribozyme.
cauggaaacugaugangaaauaaaggu

SEQ ID NO: 736 - DNA, 27 bp; single-stranded, linear
  The letter "N" represents the stem II region of an HH ribozyme.
cccauggacugaugangaaagauaaag

SEQ ID NO: 737 - DNA, 27 bp; single-stranded, linear
  The letter "N" represents the stem II region of an HH ribozyme.
ucccauggcugaugangaaaagauaaa

SEQ ID NO: 738 - DNA, 27 bp; single-stranded, linear
  The letter "N" represents the stem II region of an HH ribozyme.
cucccaugcugaugangaaaaagauaa

SEQ ID NO: 739 - DNA, 27 bp; single-stranded, linear
  The letter "N" represents the stem II region of an HH ribozyme.
aucacaaacugaugangaaagcagcug

SEQ ID NO: 740 - DNA, 27 bp; single-stranded, linear
  The letter "N" represents the stem II region of an HH ribozyme.
aaucacaacugaugangaaaagcagcu

SEQ ID NO: 741 - DNA, 27 bp; single-stranded, linear
  The letter "N" represents the stem II region of an HH ribozyme.
aaaucacacugaugangaaaaagcagc

SEQ ID NO: 742 - DNA, 27 bp; single-stranded, linear
  The letter "N" represents the stem II region of an HH ribozyme.
aaaaucaccugaugangaaaaaagcag

SEQ ID NO: 743 - DNA, 27 bp; single-stranded, linear
  The letter "N" represents the stem II region of an HH ribozyme.
auuaaaaacugaugangaaaucacaaa

SEQ ID NO: 744 - DNA, 27 bp; single-stranded, linear
  The letter "N" represents the stem II region of an HH ribozyme.
uauuaaaacugaugangaaaaucacaa

SEQ ID NO: 745 - DNA, 27 bp; single-stranded, linear
  The letter "N" represents the stem II region of an HH ribozyme.
cuauuaaacugaugangaaaaaucaca

SEQ ID NO: 746 - DNA, 27 bp; single-stranded, linear
  The letter "N" represents the stem II region of an HH ribozyme.
acuauuaacugaugangaaaaaaucac

SEQ ID NO: 747 - DNA, 27 bp; single-stranded, linear
  The letter "N" represents the stem II region of an HH ribozyme.
cacuauuacugaugangaaaaaaauca

SEQ ID NO: 748 - DNA, 27 bp; single-stranded, linear
  The letter "N" represents the stem II region of an HH ribozyme.
gcacuauucugaugangaaaaaaaauc

SEQ ID NO: 749 - DNA, 27 bp; single-stranded, linear
  The letter "N" represents the stem II region of an HH ribozyme.
agcacuaucugaugangaaaaaaaaau

SEQ ID NO: 750 - DNA, 27 bp; single-stranded, linear
  The letter "N" represents the stem II region of an HH ribozyme.
aaaagcaccugaugangaaauuaaaaa

SEQ ID NO: 751 - DNA, 27 bp; single-stranded, linear
  The letter "N" represents the stem II region of an HH ribozyme.
aaaaaaaacugaugangaaagcacuau

SEQ ID NO: 752 - DNA, 27 bp; single-stranded, linear
  The letter "N" represents the stem II region of an HH ribozyme.
aaaaaaaacugaugangaaaagcacua

SEQ ID NO: 753 - DNA, 27 bp; single-stranded, linear
  The letter "N" represents the stem II region of an HH ribozyme.
caaaaaaacugaugangaaaaagcacu

SEQ ID NO: 754 - DNA, 27 bp; single-stranded, linear
  The letter "N" represents the stem II region of an HH ribozyme.
ucaaaaaacugaugangaaaaaagcac

SEQ ID NO: 755 - DNA, 27 bp; single-stranded, linear
  The letter "N" represents the stem II region of an HH ribozyme.
gucaaaaacugaugangaaaaaaagca

SEQ ID NO: 756 - DNA, 27 bp; single-stranded, linear
  The letter "N" represents the stem II region of an HH ribozyme.
agucaaaacugaugangaaaaaaaagc

SEQ ID NO: 757 - DNA, 27 bp; single-stranded, linear
  The letter "N" represents the stem II region of an HH ribozyme.
uagucaaacugaugangaaaaaaaaag

SEQ ID NO: 758 - DNA, 27 bp; single-stranded, linear
  The letter "N" represents the stem II region of an HH ribozyme.
uuagucaacugaugangaaaaaaaaaa

SEQ ID NO: 759 - DNA, 27 bp; single-stranded, linear
  The letter "N" represents the stem II region of an HH ribozyme.
guuagucacugaugangaaaaaaaaaa

SEQ ID NO: 760 - DNA, 27 bp; single-stranded, linear
  The letter "N" represents the stem II region of an HH ribozyme.
uguuaguccugaugangaaaaaaaaaa

SEQ ID NO: 761 - DNA, 27 bp; single-stranded, linear
  The letter "N" represents the stem II region of an HH ribozyme.
auucuugucugaugangaaagucaaaa

SEQ ID NO: 762 - DNA, 27 bp; single-stranded, linear
  The letter "N" represents the stem II region of an HH ribozyme.
ucuggagucugaugangaaacauucuu

SEQ ID NO: 763 - DNA, 27 bp; single-stranded, linear
  The letter "N" represents the stem II region of an HH ribozyme.
ucuaucugcugaugangaaaguuacau

SEQ ID NO: 764 - DNA, 27 bp; single-stranded, linear
  The letter "N" represents the stem II region of an HH ribozyme.
uauuucuccugaugangaaaucuggag

SEQ ID NO: 765 - DNA, 27 bp; single-stranded, linear
  The letter "N" represents the stem II region of an HH ribozyme.
cuugucaccugaugangaaauuucucu

SEQ ID NO: 766 - DNA, 27 bp; single-stranded, linear
  The letter "N" represents the stem II region of an HH ribozyme.
uuuagcagcugaugangaaaguguucu

SEQ ID NO: 767 - DNA, 27 bp; single-stranded, linear
  The letter "N" represents the stem II region of an HH ribozyme.
ugaggauucugaugangaaagcaguag

SEQ ID NO: 768 - DNA, 27 bp; single-stranded, linear
  The letter "N" represents the stem II region of an HH ribozyme.
aacaugagcugaugangaaauuuagca

SEQ ID NO: 769 - DNA, 27 bp; single-stranded, linear
  The letter "N" represents the stem II region of an HH ribozyme.
aguaacaucugaugangaaaggauuua

SEQ ID NO: 770 - DNA, 27 bp; single-stranded, linear
  The letter "N" represents the stem II region of an HH ribozyme.
cacugagucugaugangaaacaugagg

SEQ ID NO: 771 - DNA, 27 bp; single-stranded, linear
  The letter "N" represents the stem II region of an HH ribozyme.
acacugagcugaugangaaaacaugag

SEQ ID NO: 772 - DNA, 27 bp; single-stranded, linear
  The letter "N" represents the stem II region of an HH ribozyme.
cuaacacucugaugangaaaguaacau

SEQ ID NO: 773 - DNA, 27 bp; single-stranded, linear
  The letter "N" represents the stem II region of an HH ribozyme.
auuucucucugaugangaaacacugag

SEQ ID NO: 774 - DNA, 27 bp; single-stranded, linear
  The letter "N" represents the stem II region of an HH ribozyme.
gauuucuccugaugangaaaacacuga

SEQ ID NO: 775 - DNA, 27 bp; single-stranded, linear
  The letter "N" represents the stem II region of an HH ribozyme.
uuaggaagcugaugangaaauuucucu

SEQ ID NO: 776 - DNA, 27 bp; single-stranded, linear
  The letter "N" represents the stem II region of an HH ribozyme.
gguuuaggcugaugangaaaggauuuc

SEQ ID NO: 777 - DNA, 27 bp; single-stranded, linear
  The letter "N" represents the stem II region of an HH ribozyme.
ggguuuagcugaugangaaaaggauuu

SEQ ID NO: 778 - DNA, 27 bp; single-stranded, linear
  The letter "N" represents the stem II region of an HH ribozyme.
auuggguucugaugangaaaggaagga

SEQ ID NO: 779 - DNA, 27 bp; single-stranded, linear
  The letter "N" represents the stem II region of an HH ribozyme.
gagcagggcugaugangaaagucauug

SEQ ID NO: 780 - DNA, 27 bp; single-stranded, linear
  The letter "N" represents the stem II region of an HH ribozyme.
ggagcaggcugaugangaaaagucauu

SEQ ID NO: 781 - DNA, 27 bp; single-stranded, linear
  The letter "N" represents the stem II region of an HH ribozyme.
ggggguugcugaugangaaagcaggga

SEQ ID NO: 782 - DNA, 27 bp; single-stranded, linear
  The letter "N" represents the stem II region of an HH ribozyme.
cgugcccucugaugangaaagguggcg

SEQ ID NO: 783 - DNA, 27 bp; single-stranded, linear
  The letter "N" represents the stem II region of an HH ribozyme.
cucaaucacugaugangaaacuggucc

SEQ ID NO: 784 - DNA, 27 bp; single-stranded, linear
  The letter "N" represents the stem II region of an HH ribozyme.
ccucaauccugaugangaaaacugguc

SEQ ID NO: 785 - DNA, 27 bp; single-stranded, linear
  The letter "N" represents the stem II region of an HH ribozyme.
agcuccuccugaugangaaaucaaacu

SEQ ID NO: 786 - DNA, 27 bp; single-stranded, linear
  The letter "N" represents the stem II region of an HH ribozyme.
cauugggucugaugangaaaucagugc

SEQ ID NO: 787 - DNA, 27 bp; single-stranded, linear
  The letter "N" represents the stem II region of an HH ribozyme.
ggguacgucugaugangaaaugcauug

SEQ ID NO: 788 - DNA, 27 bp; single-stranded, linear
  The letter "N" represents the stem II region of an HH ribozyme.
caguggggcugaugangaaacgugaug

SEQ ID NO: 789 - DNA, 27 bp; single-stranded, linear
  The letter "N" represents the stem II region of an HH ribozyme.
cuggggcucugaugangaaacgggcuu

SEQ ID NO: 790 - DNA, 27 bp; single-stranded, linear
  The letter "N" represents the stem II region of an HH ribozyme.
ccuggggccugaugangaaaacgggcu

SEQ ID NO: 791 - DNA, 27 bp; single-stranded, linear
  The letter "N" represents the stem II region of an HH ribozyme.
cagccagucugaugangaaauccccug

SEQ ID NO: 792 - DNA, 27 bp; single-stranded, linear
  The letter "N" represents the stem II region of an HH ribozyme.
acucccgacugaugangaaauguugcu

SEQ ID NO: 793 - DNA, 27 bp; single-stranded, linear
  The letter "N" represents the stem II region of an HH ribozyme.
ggacuccccugaugangaaagauguug

SEQ ID NO: 794 - DNA, 27 bp; single-stranded, linear
  The letter "N" represents the stem II region of an HH ribozyme.
ugcuagagcugaugangaaacucccga

SEQ ID NO: 795 - DNA, 27 bp; single-stranded, linear
  The letter "N" represents the stem II region of an HH ribozyme.
gccugcuacugaugangaaaggacucc

SEQ ID NO: 796 - DNA, 27 bp; single-stranded, linear
  The letter "N" represents the stem II region of an HH ribozyme.
aggccugccugaugangaaagaggacu

SEQ ID NO: 797 - DNA, 27 bp; single-stranded, linear
  The letter "N" represents the stem II region of an HH ribozyme.
acaugucucugaugangaaaggccugc

SEQ ID NO: 798 - DNA, 27 bp; single-stranded, linear
  The letter "N" represents the stem II region of an HH ribozyme.
gcgucucacugaugangaaauucuuuc

SEQ ID NO: 799 - DNA, 27 bp; single-stranded, linear
  The letter "N" represents the stem II region of an HH ribozyme.
ugcgucuccugaugangaaaauucuuu

SEQ ID NO: 800 - DNA, 27 bp; single-stranded, linear
  The letter "N" represents the stem II region of an HH ribozyme.
gcauugcucugaugangaaagccccgu

SEQ ID NO: 801 - DNA, 27 bp; single-stranded, linear
  The letter "N" represents the stem II region of an HH ribozyme.
gccacugacugaugangaaauggcauu

SEQ ID NO: 802 - DNA, 27 bp; single-stranded, linear
  The letter "N" represents the stem II region of an HH ribozyme.
agccacugcugaugangaaaauggcau

SEQ ID NO: 803 - DNA, 27 bp; single-stranded, linear
  The letter "N" represents the stem II region of an HH ribozyme.
aagccacucugaugangaaaaauggca

SEQ ID NO: 804 - DNA, 27 bp; single-stranded, linear
  The letter "N" represents the stem II region of an HH ribozyme.
gagcugggcugaugangaaagccacug

SEQ ID NO: 805 - DNA, 27 bp; single-stranded, linear
  The letter "N" represents the stem II region of an HH ribozyme.
agagcuggcugaugangaaaagccacu

SEQ ID NO: 806 - DNA, 27 bp; single-stranded, linear
  The letter "N" represents the stem II region of an HH ribozyme.
aagggucacugaugangaaagcuggga

SEQ ID NO: 807 - DNA, 27 bp; single-stranded, linear
  The letter "N" represents the stem II region of an HH ribozyme.
aaauguagcugaugangaaagggucag

SEQ ID NO: 808 - DNA, 27 bp; single-stranded, linear
  The letter "N" represents the stem II region of an HH ribozyme.
caaauguacugaugangaaaaggguca

SEQ ID NO: 809 - DNA, 27 bp; single-stranded, linear
  The letter "N" represents the stem II region of an HH ribozyme.
cucaaaugcugaugangaaagaagggu

SEQ ID NO: 810 - DNA, 27 bp; single-stranded, linear
  The letter "N" represents the stem II region of an HH ribozyme.
ggcccucacugaugangaaauguagaa

SEQ ID NO: 811 - DNA, 27 bp; single-stranded, linear
  The letter "N" represents the stem II region of an HH ribozyme.
gggcccuccugaugangaaaauguaga

SEQ ID NO: 812 - DNA, 27 bp; single-stranded, linear
  The letter "N" represents the stem II region of an HH ribozyme.
auccagaacugaugangaaaugucccc

SEQ ID NO: 813 - DNA, 27 bp; single-stranded, linear
  The letter "N" represents the stem II region of an HH ribozyme.
aauccagacugaugangaaaauguccc

SEQ ID NO: 814 - DNA, 27 bp; single-stranded, linear
  The letter "N" represents the stem II region of an HH ribozyme.
gaauccagcugaugangaaaaaugucc

SEQ ID NO: 815 - DNA, 27 bp; single-stranded, linear
  The letter "N" represents the stem II region of an HH ribozyme.
agaauccacugaugangaaaaaauguc

SEQ ID NO: 816 - DNA, 27 bp; single-stranded, linear
  The letter "N" represents the stem II region of an HH ribozyme.
ccucccagcugaugangaaauccagaa

SEQ ID NO: 817 - DNA, 27 bp; single-stranded, linear
  The letter "N" represents the stem II region of an HH ribozyme.
gccucccacugaugangaaaauccaga

SEQ ID NO: 818 - DNA, 27 bp; single-stranded, linear
  The letter "N" represents the stem II region of an HH ribozyme.
aaaaaagacugaugangaaauuugucc

SEQ ID NO: 819 - DNA, 27 bp; single-stranded, linear
  The letter "N" represents the stem II region of an HH ribozyme.
ccaaaaaacugaugangaaauauuugu

SEQ ID NO: 820 - DNA, 27 bp; single-stranded, linear
  The letter "N" represents the stem II region of an HH ribozyme.
uuccaaaacugaugangaaagauauuu

SEQ ID NO: 821 - DNA, 27 bp; single-stranded, linear
  The letter "N" represents the stem II region of an HH ribozyme.
guuccaaacugaugangaaaagauauu

SEQ ID NO: 822 - DNA, 27 bp; single-stranded, linear
  The letter "N" represents the stem II region of an HH ribozyme.
aguuccaacugaugangaaaaagauau

SEQ ID NO: 823 - DNA, 27 bp; single-stranded, linear
  The letter "N" represents the stem II region of an HH ribozyme.
uaguuccacugaugangaaaaaagaua

SEQ ID NO: 824 - DNA, 27 bp; single-stranded, linear
  The letter "N" represents the stem II region of an HH ribozyme.
uuaguucccugaugangaaaaaaagau

SEQ ID NO: 825 - DNA, 27 bp; single-stranded, linear
  The letter "N" represents the stem II region of an HH ribozyme.
auuugcuucugaugangaaaguuccaa

SEQ ID NO: 826 - DNA, 27 bp; single-stranded, linear
  The letter "N" represents the stem II region of an HH ribozyme.
aggucuaacugaugangaaauuugcuu

SEQ ID NO: 827 - DNA, 27 bp; single-stranded, linear
  The letter "N" represents the stem II region of an HH ribozyme.
aaggucuacugaugangaaaauuugcu

SEQ ID NO: 828 - DNA, 27 bp; single-stranded, linear
  The letter "N" represents the stem II region of an HH ribozyme.
aaaggucucugaugangaaaaauuugc

SEQ ID NO: 829 - DNA, 27 bp; single-stranded, linear
  The letter "N" represents the stem II region of an HH ribozyme.
uaaagguccugaugangaaaaaauuug

SEQ ID NO: 830 - DNA, 27 bp; single-stranded, linear
  The letter "N" represents the stem II region of an HH ribozyme.
cauagguacugaugangaaaggucuaa

SEQ ID NO: 831 - DNA, 27 bp; single-stranded, linear
  The letter "N" represents the stem II region of an HH ribozyme.
ccauaggucugaugangaaaaggucua

SEQ ID NO: 832 - DNA, 27 bp; single-stranded, linear
  The letter "N" represents the stem II region of an HH ribozyme.
uccauaggcugaugangaaaaaggucu

SEQ ID NO: 833 - DNA, 27 bp; single-stranded, linear
  The letter "N" represents the stem II region of an HH ribozyme.
cacuuccacugaugangaaagguaaag

SEQ ID NO: 834 - DNA, 27 bp; single-stranded, linear
  The letter "N" represents the stem II region of an HH ribozyme.
ggacauagcugaugangaaaccacuuc

SEQ ID NO: 835 - DNA, 27 bp; single-stranded, linear
  The letter "N" represents the stem II region of an HH ribozyme.
uggacauacugaugangaaaaccacuu

SEQ ID NO: 836 - DNA, 27 bp; single-stranded, linear
  The letter "N" represents the stem II region of an HH ribozyme.
aauggacacugaugangaaagaaccac

SEQ ID NO: 837 - DNA, 27 bp; single-stranded, linear
  The letter "N" represents the stem II region of an HH ribozyme.
ugagaaugcugaugangaaacauagaa

SEQ ID NO: 838 - DNA, 27 bp; single-stranded, linear
  The letter "N" represents the stem II region of an HH ribozyme.
cgaaugagcugaugangaaauggacau

SEQ ID NO: 839 - DNA, 27 bp; single-stranded, linear
  The letter "N" represents the stem II region of an HH ribozyme.
acgaaugacugaugangaaaauggaca

SEQ ID NO: 840 - DNA, 27 bp; single-stranded, linear
  The letter "N" represents the stem II region of an HH ribozyme.
ccacgaaucugaugangaaagaaugga

SEQ ID NO: 841 - DNA, 27 bp; single-stranded, linear
  The letter "N" represents the stem II region of an HH ribozyme.
augccacgcugaugangaaaugagaau

SEQ ID NO: 842 - DNA, 27 bp; single-stranded, linear
  The letter "N" represents the stem II region of an HH ribozyme.
caugccaccugaugangaaaaugagaa

SEQ ID NO: 843 - DNA, 27 bp; single-stranded, linear
  The letter "N" represents the stem II region of an HH ribozyme.
caaaucaacugaugangaaacaugcca

SEQ ID NO: 844 - DNA, 27 bp; single-stranded, linear
  The letter "N" represents the stem II region of an HH ribozyme.
acaaaucacugaugangaaaacaugcc

SEQ ID NO: 845 - DNA, 27 bp; single-stranded, linear
  The letter "N" represents the stem II region of an HH ribozyme.
uacaaauccugaugangaaaaacaugc

SEQ ID NO: 846 - DNA, 27 bp; single-stranded, linear
  The letter "N" represents the stem II region of an HH ribozyme.
gugcuacacugaugangaaaucaaaac

SEQ ID NO: 847 - DNA, 27 bp; single-stranded, linear
  The letter "N" represents the stem II region of an HH ribozyme.
agugcuaccugaugangaaaaucaaaa

SEQ ID NO: 848 - DNA, 27 bp; single-stranded, linear
  The letter "N" represents the stem II region of an HH ribozyme.
cucagugccugaugangaaacaaauca

SEQ ID NO: 849 - DNA, 27 bp; single-stranded, linear
  The letter "N" represents the stem II region of an HH ribozyme.
ucagaguucugaugangaaagugccac

SEQ ID NO: 850 - DNA, 27 bp; single-stranded, linear
  The letter "N" represents the stem II region of an HH ribozyme.
ugggcucacugaugangaaaguugagu

SEQ ID NO: 851 - DNA, 27 bp; single-stranded, linear
  The letter "N" represents the stem II region of an HH ribozyme.
gccaaaagcugaugangaaaugggcuc

SEQ ID NO: 852 - DNA, 27 bp; single-stranded, linear
  The letter "N" represents the stem II region of an HH ribozyme.
ggagccaacugaugangaaaguauggg

SEQ ID NO: 853 - DNA, 27 bp; single-stranded, linear
  The letter "N" represents the stem II region of an HH ribozyme.
aggagccacugaugangaaaaguaugg

SEQ ID NO: 854 - DNA, 27 bp; single-stranded, linear
  The letter "N" represents the stem II region of an HH ribozyme.
gaggagcccugaugangaaaaaguaug

SEQ ID NO: 855 - DNA, 27 bp; single-stranded, linear
  The letter "N" represents the stem II region of an HH ribozyme.
uacuagagcugaugangaaagccaaaa

SEQ ID NO: 856 - DNA, 27 bp; single-stranded, linear
  The letter "N" represents the stem II region of an HH ribozyme.
ucuuacuacugaugangaaaggagcca

SEQ ID NO: 857 - DNA, 27 bp; single-stranded, linear
  The letter "N" represents the stem II region of an HH ribozyme.
caucuuaccugaugangaaagaggagc

SEQ ID NO: 858 - DNA, 27 bp; single-stranded, linear
  The letter "N" represents the stem II region of an HH ribozyme.
gugcaucucugaugangaaacuagagg

SEQ ID NO: 859 - DNA, 27 bp; single-stranded, linear
  The letter "N" represents the stem II region of an HH ribozyme.
cucuggcucugaugangaaaguuuuca

SEQ ID NO: 860 - DNA, 27 bp; single-stranded, linear
  The letter "N" represents the stem II region of an HH ribozyme.
acucuggccugaugangaaaaguuuuc

SEQ ID NO: 861 - DNA, 27 bp; single-stranded, linear
  The letter "N" represents the stem II region of an HH ribozyme.
gacaaccucugaugangaaacucuggc

SEQ ID NO: 862 - DNA, 27 bp; single-stranded, linear
  The letter "N" represents the stem II region of an HH ribozyme.
agacaacccugaugangaaaacucugg

SEQ ID NO: 863 - DNA, 27 bp; single-stranded, linear
  The letter "N" represents the stem II region of an HH ribozyme.
cuggagaccugaugangaaaccuaacu

SEQ ID NO: 864 - DNA, 27 bp; single-stranded, linear
  The letter "N" represents the stem II region of an HH ribozyme.
ggccuggacugaugangaaacaaccua

SEQ ID NO: 865 - DNA, 27 bp; single-stranded, linear
  The letter "N" represents the stem II region of an HH ribozyme.
auggccugcugaugangaaagacaacc

SEQ ID NO: 866 - DNA, 27 bp; single-stranded, linear
  The letter "N" represents the stem II region of an HH ribozyme.
uucagugucugaugangaaaggccauc

SEQ ID NO: 867 - DNA, 27 bp; single-stranded, linear
  The letter "N" represents the stem II region of an HH ribozyme.
uuucagugcugaugangaaaaggccau

SEQ ID NO: 868 - DNA, 27 bp; single-stranded, linear
  The letter "N" represents the stem II region of an HH ribozyme.
uagaaugucugaugangaaacauuuuc

SEQ ID NO: 869 - DNA, 27 bp; single-stranded, linear
  The letter "N" represents the stem II region of an HH ribozyme.
caaaauagcugaugangaaaugugaca

SEQ ID NO: 870 - DNA, 27 bp; single-stranded, linear
  The letter "N" represents the stem II region of an HH ribozyme.
ccaaaauacugaugangaaaaugugac

SEQ ID NO: 871 - DNA, 27 bp; single-stranded, linear
  The letter "N" represents the stem II region of an HH ribozyme.
acccaaaacugaugangaaagaaugug

SEQ ID NO: 872 - DNA, 27 bp; single-stranded, linear
  The letter "N" represents the stem II region of an HH ribozyme.
auacccaacugaugangaaauagaaug

SEQ ID NO: 873 - DNA, 27 bp; single-stranded, linear
  The letter "N" represents the stem II region of an HH ribozyme.
aauacccacugaugangaaaauagaau

SEQ ID NO: 874 - DNA, 27 bp; single-stranded, linear
  The letter "N" represents the stem II region of an HH ribozyme.
uaauaccccugaugangaaaaauagaa

SEQ ID NO: 875 - DNA, 27 bp; single-stranded, linear
  The letter "N" represents the stem II region of an HH ribozyme.
uauauuaacugaugangaaacccaaaa

SEQ ID NO: 876 - DNA, 27 bp; single-stranded, linear
  The letter "N" represents the stem II region of an HH ribozyme.
uauauauucugaugangaaauacccaa

SEQ ID NO: 877 - DNA, 27 bp; single-stranded, linear
  The letter "N" represents the stem II region of an HH ribozyme.
cuauauaucugaugangaaaauaccca

SEQ ID NO: 878 - DNA, 27 bp; single-stranded, linear
  The letter "N" represents the stem II region of an HH ribozyme.
ggacuauacugaugangaaauuaauac

SEQ ID NO: 879 - DNA, 27 bp; single-stranded, linear
  The letter "N" represents the stem II region of an HH ribozyme.
cuggacuacugaugangaaauauuaau

SEQ ID NO: 880 - DNA, 27 bp; single-stranded, linear
  The letter "N" represents the stem II region of an HH ribozyme.
gucuggaccugaugangaaauauauua

SEQ ID NO: 881 - DNA, 27 bp; single-stranded, linear
  The letter "N" represents the stem II region of an HH ribozyme.
agugucugcugaugangaaacuauaua

SEQ ID NO: 882 - DNA, 27 bp; single-stranded, linear
  The letter "N" represents the stem II region of an HH ribozyme.
auugaguucugaugangaaagugucug

SEQ ID NO: 883 - DNA, 27 bp; single-stranded, linear
  The letter "N" represents the stem II region of an HH ribozyme.
aauugagucugaugangaaaagugucu

SEQ ID NO: 884 - DNA, 27 bp; single-stranded, linear
  The letter "N" represents the stem II region of an HH ribozyme.
aagaaauucugaugangaaaguuaagu

SEQ ID NO: 885 - DNA, 27 bp; single-stranded, linear
  The letter "N" represents the stem II region of an HH ribozyme.
uaccaagacugaugangaaauugaguu

SEQ ID NO: 886 - DNA, 27 bp; single-stranded, linear
  The letter "N" represents the stem II region of an HH ribozyme.
auaccaagcugaugangaaaauugagu

SEQ ID NO: 887 - DNA, 27 bp; single-stranded, linear
  The letter "N" represents the stem II region of an HH ribozyme.
aauaccaacugaugangaaaaauugag

SEQ ID NO: 888 - DNA, 27 bp; single-stranded, linear
  The letter "N" represents the stem II region of an HH ribozyme.
auaauacccugaugangaaagaaauug

SEQ ID NO: 889 - DNA, 27 bp; single-stranded, linear
  The letter "N" represents the stem II region of an HH ribozyme.
cagaauaacugaugangaaaccaagaa

SEQ ID NO: 890 - DNA, 27 bp; single-stranded, linear
  The letter "N" represents the stem II region of an HH ribozyme.
aacagaaucugaugangaaauaccaag

SEQ ID NO: 891 - DNA, 27 bp; single-stranded, linear
  The letter "N" represents the stem II region of an HH ribozyme.
aaacagaacugaugangaaaauaccaa

SEQ ID NO: 892 - DNA, 27 bp; single-stranded, linear
  The letter "N" represents the stem II region of an HH ribozyme.
caaaacagcugaugangaaauaauacc

SEQ ID NO: 893 - DNA, 27 bp; single-stranded, linear
  The letter "N" represents the stem II region of an HH ribozyme.
gcaaaacacugaugangaaaauaauac

SEQ ID NO: 894 - DNA, 27 bp; single-stranded, linear
  The letter "N" represents the stem II region of an HH ribozyme.
cugugcaacugaugangaaacagaaua

SEQ ID NO: 895 - DNA, 27 bp; single-stranded, linear
  The letter "N" represents the stem II region of an HH ribozyme.
acugugcacugaugangaaaacagaau

SEQ ID NO: 896 - DNA, 27 bp; single-stranded, linear
  The letter "N" represents the stem II region of an HH ribozyme.
aacugugccugaugangaaaaacagaa

SEQ ID NO: 897 - DNA, 27 bp; single-stranded, linear
  The letter "N" represents the stem II region of an HH ribozyme.
ucacaacucugaugangaaacugugca

SEQ ID NO: 898 - DNA, 27 bp; single-stranded, linear
  The letter "N" represents the stem II region of an HH ribozyme.
uucacaaccugaugangaaaacugugc

SEQ ID NO: 899 - DNA, 27 bp; single-stranded, linear
  The letter "N" represents the stem II region of an HH ribozyme.
ucuuucaccugaugangaaacuaacug

SEQ ID NO: 900 - DNA, 27 bp; single-stranded, linear
  The letter "N" represents the stem II region of an HH ribozyme.
cuccucagcugaugangaaacugcauu

SEQ ID NO: 901 - DNA, 27 bp; single-stranded, linear
  The letter "N" represents the stem II region of an HH ribozyme.
auggagaacugaugangaaacucuccu

SEQ ID NO: 902 - DNA, 27 bp; single-stranded, linear
  The letter "N" represents the stem II region of an HH ribozyme.
uauggagacugaugangaaaacucucc

SEQ ID NO: 903 - DNA, 27 bp; single-stranded, linear
  The letter "N" represents the stem II region of an HH ribozyme.
auauggagcugaugangaaaaacucuc

SEQ ID NO: 904 - DNA, 27 bp; single-stranded, linear
  The letter "N" represents the stem II region of an HH ribozyme.
gauauggacugaugangaaaaaacucu

SEQ ID NO: 905 - DNA, 27 bp; single-stranded, linear
  The letter "N" represents the stem II region of an HH ribozyme.
uugauaugcugaugangaaagaaaacu

SEQ ID NO: 906 - DNA, 27 bp; single-stranded, linear
  The letter "N" represents the stem II region of an HH ribozyme.
cguuuugacugaugangaaauggagaa

SEQ ID NO: 907 - DNA, 27 bp; single-stranded, linear
  The letter "N" represents the stem II region of an HH ribozyme.
cucguuuucugaugangaaauauggag

SEQ ID NO: 908 - DNA, 27 bp; single-stranded, linear
  The letter "N" represents the stem II region of an HH ribozyme.
accuuauucugaugangaaaccuuuuu

SEQ ID NO: 909 - DNA, 27 bp; single-stranded, linear
  The letter "N" represents the stem II region of an HH ribozyme.
cuugaccucugaugangaaauugaccu

SEQ ID NO: 910 - DNA, 27 bp; single-stranded, linear
  The letter "N" represents the stem II region of an HH ribozyme.
cuucccuucugaugangaaaccuuauu

SEQ ID NO: 911 - DNA, 27 bp; single-stranded, linear
  The letter "N" represents the stem II region of an HH ribozyme.
gguauagacugaugangaaacgggguc

SEQ ID NO: 912 - DNA, 27 bp; single-stranded, linear
  The letter "N" represents the stem II region of an HH ribozyme.
uugguauacugaugangaaagacgggg

SEQ ID NO: 913 - DNA, 27 bp; single-stranded, linear
  The letter "N" represents the stem II region of an HH ribozyme.
gguugguacugaugangaaagagacgg

SEQ ID NO: 914 - DNA, 27 bp; single-stranded, linear
  The letter "N" represents the stem II region of an HH ribozyme.
uugguuggcugaugangaaauagagac

SEQ ID NO: 915 - DNA, 27 bp; single-stranded, linear
  The letter "N" represents the stem II region of an HH ribozyme.
uguuggugcugaugangaaauugguuu

SEQ ID NO: 916 - DNA, 27 bp; single-stranded, linear
  The letter "N" represents the stem II region of an HH ribozyme.
guguuggucugaugangaaaauugguu

SEQ ID NO: 917 - DNA, 27 bp; single-stranded, linear
  The letter "N" represents the stem II region of an HH ribozyme.
uggguccccugaugangaaacuguguu

SEQ ID NO: 918 - DNA, 27 bp; single-stranded, linear
  The letter "N" represents the stem II region of an HH ribozyme.
acgugacucugaugangaaacuuccug

SEQ ID NO: 919 - DNA, 27 bp; single-stranded, linear
  The letter "N" represents the stem II region of an HH ribozyme.
ggaaacgucugaugangaaacugacuu

SEQ ID NO: 920 - DNA, 27 bp; single-stranded, linear
  The letter "N" represents the stem II region of an HH ribozyme.
gaaaaggacugaugangaaacgugacu

SEQ ID NO: 921 - DNA, 27 bp; single-stranded, linear
  The letter "N" represents the stem II region of an HH ribozyme.
ugaaaaggcugaugangaaaacgugac

SEQ ID NO: 922 - DNA, 27 bp; single-stranded, linear
  The letter "N" represents the stem II region of an HH ribozyme.
augaaaagcugaugangaaaaacguga

SEQ ID NO: 923 - DNA, 27 bp; single-stranded, linear
  The letter "N" represents the stem II region of an HH ribozyme.
uaaaugaacugaugangaaaggaaacg

SEQ ID NO: 924 - DNA, 27 bp; single-stranded, linear
  The letter "N" represents the stem II region of an HH ribozyme.
uuaaaugacugaugangaaaaggaaac

SEQ ID NO: 925 - DNA, 27 bp; single-stranded, linear
  The letter "N" represents the stem II region of an HH ribozyme.
auuaaaugcugaugangaaaaaggaaa

SEQ ID NO: 926 - DNA, 27 bp; single-stranded, linear
  The letter "N" represents the stem II region of an HH ribozyme.
cauuaaaucugaugangaaaaaaggaa

SEQ ID NO: 927 - DNA, 27 bp; single-stranded, linear
  The letter "N" represents the stem II region of an HH ribozyme.
ccccauuacugaugangaaaugaaaag

SEQ ID NO: 928 - DNA, 27 bp; single-stranded, linear
  The letter "N" represents the stem II region of an HH ribozyme.
uccccauucugaugangaaaaugaaaa

SEQ ID NO: 929 - DNA, 27 bp; single-stranded, linear
  The letter "N" represents the stem II region of an HH ribozyme.
auccccaucugaugangaaaaaugaaa

SEQ ID NO: 930 - DNA, 27 bp; single-stranded, linear
  The letter "N" represents the stem II region of an HH ribozyme.
gauaguggcugaugangaaauccccau

SEQ ID NO: 931 - DNA, 27 bp; single-stranded, linear
  The letter "N" represents the stem II region of an HH ribozyme.
agauagugcugaugangaaaaucccca

SEQ ID NO: 932 - DNA, 27 bp; single-stranded, linear
  The letter "N" represents the stem II region of an HH ribozyme.
gugugagacugaugangaaaguggaau

SEQ ID NO: 933 - DNA, 27 bp; single-stranded, linear
  The letter "N" represents the stem II region of an HH ribozyme.
uagugugacugaugangaaauagugga

SEQ ID NO: 934 - DNA, 27 bp; single-stranded, linear
  The letter "N" represents the stem II region of an HH ribozyme.
auuagugucugaugangaaagauagug

SEQ ID NO: 935 - DNA, 27 bp; single-stranded, linear
  The letter "N" represents the stem II region of an HH ribozyme.
uuucagaucugaugangaaagugugag

SEQ ID NO: 936 - DNA, 27 bp; single-stranded, linear
  The letter "N" represents the stem II region of an HH ribozyme.
uccuuucacugaugangaaauuagugu

SEQ ID NO: 937 - DNA, 27 bp; single-stranded, linear
  The letter "N" represents the stem II region of an HH ribozyme.
cgccagcucugaugangaaaugcucuu

SEQ ID NO: 938 - DNA, 27 bp; single-stranded, linear
  The letter "N" represents the stem II region of an HH ribozyme.
gcgccagccugaugangaaaaugcucu

SEQ ID NO: 939 - DNA, 27 bp; single-stranded, linear
  The letter "N" represents the stem II region of an HH ribozyme.
gugcuuaacugaugangaaaugcgcca

SEQ ID NO: 940 - DNA, 27 bp; single-stranded, linear
  The letter "N" represents the stem II region of an HH ribozyme.
aagugcuucugaugangaaauaugcgc

SEQ ID NO: 941 - DNA, 27 bp; single-stranded, linear
  The letter "N" represents the stem II region of an HH ribozyme.
aaagugcucugaugangaaaauaugcg

SEQ ID NO: 942 - DNA, 27 bp; single-stranded, linear
  The letter "N" represents the stem II region of an HH ribozyme.
ggagcuuacugaugangaaagugcuua

SEQ ID NO: 943 - DNA, 27 bp; single-stranded, linear
  The letter "N" represents the stem II region of an HH ribozyme.
aggagcuucugaugangaaaagugcuu

SEQ ID NO: 944 - DNA, 27 bp; single-stranded, linear
  The letter "N" represents the stem II region of an HH ribozyme.
aaggagcucugaugangaaaaagugcu

SEQ ID NO: 945 - DNA, 27 bp; single-stranded, linear
  The letter "N" represents the stem II region of an HH ribozyme.
uacucaagcugaugangaaagcuuaaa

SEQ ID NO: 946 - DNA, 27 bp; single-stranded, linear
  The letter "N" represents the stem II region of an HH ribozyme.
uuuuacuccugaugangaaaggagcuu

SEQ ID NO: 947 - DNA, 27 bp; single-stranded, linear
  The letter "N" represents the stem II region of an HH ribozyme.
caccuuuucugaugangaaacucaagg

SEQ ID NO: 948 - DNA, 27 bp; single-stranded, linear
  The letter "N" represents the stem II region of an HH ribozyme.
aaauuacacugaugangaaaccaccuu

SEQ ID NO: 949 - DNA, 27 bp; single-stranded, linear
  The letter "N" represents the stem II region of an HH ribozyme.
gcauaaaucugaugangaaacauacca

SEQ ID NO: 950 - DNA, 27 bp; single-stranded, linear
  The letter "N" represents the stem II region of an HH ribozyme.
cuugcauacugaugangaaauuacaua

SEQ ID NO: 951 - DNA, 27 bp; single-stranded, linear
  The letter "N" represents the stem II region of an HH ribozyme.
ccuugcaucugaugangaaaauuacau

SEQ ID NO: 952 - DNA, 27 bp; single-stranded, linear
  The letter "N" represents the stem II region of an HH ribozyme.
accuugcacugaugangaaaaauuaca

SEQ ID NO: 953 - DNA, 27 bp; single-stranded, linear
  The letter "N" represents the stem II region of an HH ribozyme.
uggagaaacugaugangaaaccuugca

SEQ ID NO: 954 - DNA, 27 bp; single-stranded, linear
  The letter "N" represents the stem II region of an HH ribozyme.
acuggagacugaugangaaauaccuug

SEQ ID NO: 955 - DNA, 27 bp; single-stranded, linear
  The letter "N" represents the stem II region of an HH ribozyme.
aacuggagcugaugangaaaauaccuu

SEQ ID NO: 956 - DNA, 27 bp; single-stranded, linear
  The letter "N" represents the stem II region of an HH ribozyme.
caacuggacugaugangaaaaauaccu

SEQ ID NO: 957 - DNA, 27 bp; single-stranded, linear
  The letter "N" represents the stem II region of an HH ribozyme.
cccaacugcugaugangaaagaaauac

SEQ ID NO: 958 - DNA, 27 bp; single-stranded, linear
  The letter "N" represents the stem II region of an HH ribozyme.
ugaguccccugaugangaaacuggaga

SEQ ID NO: 959 - DNA, 27 bp; single-stranded, linear
  The letter "N" represents the stem II region of an HH ribozyme.
aauauccucugaugangaaagucccaa

SEQ ID NO: 960 - DNA, 27 bp; single-stranded, linear
  The letter "N" represents the stem II region of an HH ribozyme.
uuaacuaacugaugangaaauccugag

SEQ ID NO: 961 - DNA, 27 bp; single-stranded, linear
  The letter "N" represents the stem II region of an HH ribozyme.
cauuaacucugaugangaaauauccug

SEQ ID NO: 962 - DNA, 27 bp; single-stranded, linear
  The letter "N" represents the stem II region of an HH ribozyme.
ucauuaaccugaugangaaaauauccu

SEQ ID NO: 963 - DNA, 27 bp; single-stranded, linear
  The letter "N" represents the stem II region of an HH ribozyme.
ggcucauucugaugangaaacuaauau

SEQ ID NO: 964 - DNA, 27 bp; single-stranded, linear
  The letter "N" represents the stem II region of an HH ribozyme.
uggcucaucugaugangaaaacuaaua

SEQ ID NO: 965 - DNA, 27 bp; single-stranded, linear
  The letter "N" represents the stem II region of an HH ribozyme.
cuucuagucugaugangaaauggcuca

SEQ ID NO: 966 - DNA, 27 bp; single-stranded, linear
  The letter "N" represents the stem II region of an HH ribozyme.
uuuucuuccugaugangaaagugaugg

SEQ ID NO: 967 - DNA, 27 bp; single-stranded, linear
  The letter "N" represents the stem II region of an HH ribozyme.
caguugaacugaugangaaaugggcuu

SEQ ID NO: 968 - DNA, 27 bp; single-stranded, linear
  The letter "N" represents the stem II region of an HH ribozyme.
gcaguugacugaugangaaaaugggcu

SEQ ID NO: 969 - DNA, 27 bp; single-stranded, linear
  The letter "N" represents the stem II region of an HH ribozyme.
agcaguugcugaugangaaaaaugggc

SEQ ID NO: 970 - DNA, 27 bp; single-stranded, linear
  The letter "N" represents the stem II region of an HH ribozyme.
aagcaguucugaugangaaaaaauggg

SEQ ID NO: 971 - DNA, 27 bp; single-stranded, linear
  The letter "N" represents the stem II region of an HH ribozyme.
aaguuucacugaugangaaagcaguug

SEQ ID NO: 972 - DNA, 27 bp; single-stranded, linear
  The letter "N" represents the stem II region of an HH ribozyme.
caaguuuccugaugangaaaagcaguu

SEQ ID NO: 973 - DNA, 27 bp; single-stranded, linear
  The letter "N" represents the stem II region of an HH ribozyme.
ccccaggccugaugangaaaguuucaa

SEQ ID NO: 974 - DNA, 27 bp; single-stranded, linear
  The letter "N" represents the stem II region of an HH ribozyme.
caugcucacugaugangaaaccccagg

SEQ ID NO: 975 - DNA, 27 bp; single-stranded, linear
  The letter "N" represents the stem II region of an HH ribozyme.
ugucuccccugaugangaaauucccau

SEQ ID NO: 976 - DNA, 27 bp; single-stranded, linear
  The letter "N" represents the stem II region of an HH ribozyme.
cccuuucccugaugangaaacccuguc

SEQ ID NO: 977 - DNA, 27 bp; single-stranded, linear
  The letter "N" represents the stem II region of an HH ribozyme.
cugaagagcugaugangaaaggcgccc

SEQ ID NO: 978 - DNA, 27 bp; single-stranded, linear
  The letter "N" represents the stem II region of an HH ribozyme.
acccugaacugaugangaaaguaggcg

SEQ ID NO: 979 - DNA, 27 bp; single-stranded, linear
  The letter "N" represents the stem II region of an HH ribozyme.
agacccugcugaugangaaagaguagg

SEQ ID NO: 980 - DNA, 27 bp; single-stranded, linear
  The letter "N" represents the stem II region of an HH ribozyme.
uagacccucugaugangaaaagaguag

SEQ ID NO: 981 - DNA, 27 bp; single-stranded, linear
  The letter "N" represents the stem II region of an HH ribozyme.
gaucuuuacugaugangaaacccugaa

SEQ ID NO: 982 - DNA, 27 bp; single-stranded, linear
  The letter "N" represents the stem II region of an HH ribozyme.
uugaucuucugaugangaaagacccug

SEQ ID NO: 983 - DNA, 27 bp; single-stranded, linear
  The letter "N" represents the stem II region of an HH ribozyme.
gcccacuucugaugangaaaucuuuag

SEQ ID NO: 984 - DNA, 27 bp; single-stranded, linear
  The letter "N" represents the stem II region of an HH ribozyme.
agcgaucccugaugangaaaggcccac

SEQ ID NO: 985 - DNA, 27 bp; single-stranded, linear
  The letter "N" represents the stem II region of an HH ribozyme.
agcuuagccugaugangaaauccaagg

SEQ ID NO: 986 - DNA, 27 bp; single-stranded, linear
  The letter "N" represents the stem II region of an HH ribozyme.
agccagcucugaugangaaagcgaucc

SEQ ID NO: 987 - DNA, 27 bp; single-stranded, linear
  The letter "N" represents the stem II region of an HH ribozyme.
aucaaacacugaugangaaagccagcu

SEQ ID NO: 988 - DNA, 27 bp; single-stranded, linear
  The letter "N" represents the stem II region of an HH ribozyme.
uagcaucacugaugangaaacagagcc

SEQ ID NO: 989 - DNA, 27 bp; single-stranded, linear
  The letter "N" represents the stem II region of an HH ribozyme.
auagcauccugaugangaaaacagagc

SEQ ID NO: 990 - DNA, 27 bp; single-stranded, linear
  The letter "N" represents the stem II region of an HH ribozyme.
ugcauaaacugaugangaaagcaucaa

SEQ ID NO: 991 - DNA, 27 bp; single-stranded, linear
  The letter "N" represents the stem II region of an HH ribozyme.
cuugcauacugaugangaaauagcauc

SEQ ID NO: 992 - DNA, 27 bp; single-stranded, linear
  The letter "N" represents the stem II region of an HH ribozyme.
acuugcaucugaugangaaaauagcau

SEQ ID NO: 993 - DNA, 27 bp; single-stranded, linear
  The letter "N" represents the stem II region of an HH ribozyme.
aacuugcacugaugangaaaaauagca

SEQ ID NO: 994 - DNA, 27 bp; single-stranded, linear
  The letter "N" represents the stem II region of an HH ribozyme.
uagacccucugaugangaaacuugcau

SEQ ID NO: 995 - DNA, 27 bp; single-stranded, linear
  The letter "N" represents the stem II region of an HH ribozyme.
auagaccccugaugangaaaacuugca

SEQ ID NO: 996 - DNA, 27 bp; single-stranded, linear
  The letter "N" represents the stem II region of an HH ribozyme.
aauacauacugaugangaaacccuaac

SEQ ID NO: 997 - DNA, 27 bp; single-stranded, linear
  The letter "N" represents the stem II region of an HH ribozyme.
uaaauacacugaugangaaagacccua

SEQ ID NO: 998 - DNA, 27 bp; single-stranded, linear
  The letter "N" represents the stem II region of an HH ribozyme.
auccuaaacugaugangaaacauagac

SEQ ID NO: 999 - DNA, 27 bp; single-stranded, linear
  The letter "N" represents the stem II region of an HH ribozyme.
gcauccuacugaugangaaauacauag

SEQ ID NO: 1000 - DNA, 27 bp; single-stranded, linear
  The letter "N" represents the stem II region of an HH ribozyme.
cgcauccucugaugangaaaauacaua

SEQ ID NO: 1001 - DNA, 27 bp; single-stranded, linear
  The letter "N" represents the stem II region of an HH ribozyme.
gcgcaucccugaugangaaaaauacau

SEQ ID NO: 1002 - DNA, 27 bp; single-stranded, linear
  The letter "N" represents the stem II region of an HH ribozyme.
cugaagagcugaugangaaaggcgcau

SEQ ID NO: 1003 - DNA, 27 bp; single-stranded, linear
  The letter "N" represents the stem II region of an HH ribozyme.
acccugaacugaugangaaaguaggcg

SEQ ID NO: 1004 - DNA, 27 bp; single-stranded, linear
  The letter "N" represents the stem II region of an HH ribozyme.
agacccugcugaugangaaagaguagg

SEQ ID NO: 1005 - DNA, 27 bp; single-stranded, linear
  The letter "N" represents the stem II region of an HH ribozyme.
uagacccucugaugangaaaagaguag

SEQ ID NO: 1006 - DNA, 27 bp; single-stranded, linear
  The letter "N" represents the stem II region of an HH ribozyme.
gaucuuuacugaugangaaacccugaa

SEQ ID NO: 1007 - DNA, 27 bp; single-stranded, linear
  The letter "N" represents the stem II region of an HH ribozyme.
uugaucuucugaugangaaagacccug

SEQ ID NO: 1008 - DNA, 27 bp; single-stranded, linear
  The letter "N" represents the stem II region of an HH ribozyme.
gcccacuucugaugangaaaucuuuag

SEQ ID NO: 1009 - DNA, 27 bp; single-stranded, linear
  The letter "N" represents the stem II region of an HH ribozyme.
agcgaucccugaugangaaaggcccac

SEQ ID NO: 1010 - DNA, 27 bp; single-stranded, linear
  The letter "N" represents the stem II region of an HH ribozyme.
agcuuagccugaugangaaauccaagg

SEQ ID NO: 1011 - DNA, 27 bp; single-stranded, linear
  The letter "N" represents the stem II region of an HH ribozyme.
agccagcucugaugangaaagcgaucc

SEQ ID NO: 1012 - DNA, 27 bp; single-stranded, linear
  The letter "N" represents the stem II region of an HH ribozyme.
aucaaacacugaugangaaagccagcu

SEQ ID NO: 1013 - DNA, 27 bp; single-stranded, linear
  The letter "N" represents the stem II region of an HH ribozyme.
uagcaucacugaugangaaacagagcc

SEQ ID NO: 1014 - DNA, 27 bp; single-stranded, linear
  The letter "N" represents the stem II region of an HH ribozyme.
auagcauccugaugangaaaacagagc

SEQ ID NO: 1015 - DNA, 27 bp; single-stranded, linear
  The letter "N" represents the stem II region of an HH ribozyme.
ugcauaaacugaugangaaagcaucaa

SEQ ID NO: 1016 - DNA, 27 bp; single-stranded, linear
  The letter "N" represents the stem II region of an HH ribozyme.
cuugcauacugaugangaaauagcauc

SEQ ID NO: 1017 - DNA, 27 bp; single-stranded, linear
  The letter "N" represents the stem II region of an HH ribozyme.
acuugcaucugaugangaaaauagcau

SEQ ID NO: 1018 - DNA, 27 bp; single-stranded, linear
  The letter "N" represents the stem II region of an HH ribozyme.
aacuugcacugaugangaaaaauagca

SEQ ID NO: 1019 - DNA, 27 bp; single-stranded, linear
  The letter "N" represents the stem II region of an HH ribozyme.
uagacccucugaugangaaacuugcau

SEQ ID NO: 1020 - DNA, 27 bp; single-stranded, linear
  The letter "N" represents the stem II region of an HH ribozyme.
auagaccccugaugangaaaacuugca

SEQ ID NO: 1021 - DNA, 27 bp; single-stranded, linear
  The letter "N" represents the stem II region of an HH ribozyme.
aauacauacugaugangaaacccuaac

SEQ ID NO: 1022 - DNA, 27 bp; single-stranded, linear
  The letter "N" represents the stem II region of an HH ribozyme.
uaaauacacugaugangaaagacccua

SEQ ID NO: 1023 - DNA, 27 bp; single-stranded, linear
  The letter "N" represents the stem II region of an HH ribozyme.
auccuaaacugaugangaaacauagac

SEQ ID NO: 1024 - DNA, 27 bp; single-stranded, linear
  The letter "N" represents the stem II region of an HH ribozyme.
acauccuacugaugangaaauacauag

SEQ ID NO: 1025 - DNA, 27 bp; single-stranded, linear
  The letter "N" represents the stem II region of an HH ribozyme.
gacauccucugaugangaaaauacaua

SEQ ID NO: 1026 - DNA, 27 bp; single-stranded, linear
  The letter "N" represents the stem II region of an HH ribozyme.
agacaucccugaugangaaaaauacau

SEQ ID NO: 1027 - DNA, 27 bp; single-stranded, linear
  The letter "N" represents the stem II region of an HH ribozyme.
aaggugcacugaugangaaacauccua

SEQ ID NO: 1028 - DNA, 27 bp; single-stranded, linear
  The letter "N" represents the stem II region of an HH ribozyme.
ggcugcagcugaugangaaaggugcag

SEQ ID NO: 1029 - DNA, 27 bp; single-stranded, linear
  The letter "N" represents the stem II region of an HH ribozyme.
uggcugcacugaugangaaaaggugca

SEQ ID NO: 1030 - DNA, 27 bp; single-stranded, linear
  The letter "N" represents the stem II region of an HH ribozyme.
cagcuucucugaugangaaacuggcug

SEQ ID NO: 1031 - DNA, 27 bp; single-stranded, linear
  The letter "N" represents the stem II region of an HH ribozyme.
gaagcagccugaugangaaauccacug

SEQ ID NO: 1032 - DNA, 27 bp; single-stranded, linear
  The letter "N" represents the stem II region of an HH ribozyme.
uccccaagcugaugangaaagcagcaa

SEQ ID NO: 1033 - DNA, 27 bp; single-stranded, linear
  The letter "N" represents the stem II region of an HH ribozyme.
cuccccaacugaugangaaaagcagca

SEQ ID NO: 1034 - DNA, 27 bp; single-stranded, linear
  The letter "N" represents the stem II region of an HH ribozyme.
uucucccccugaugangaaagaagcag

SEQ ID NO: 1035 - DNA, 27 bp; single-stranded, linear
  The letter "N" represents the stem II region of an HH ribozyme.
aggaagcacugaugangaaacucuucu

SEQ ID NO: 1036 - DNA, 27 bp; single-stranded, linear
  The letter "N" represents the stem II region of an HH ribozyme.
auaaaaggcugaugangaaagcauacu

SEQ ID NO: 1037 - DNA, 27 bp; single-stranded, linear
  The letter "N" represents the stem II region of an HH ribozyme.
gauaaaagcugaugangaaaagcauac

SEQ ID NO: 1038 - DNA, 27 bp; single-stranded, linear
  The letter "N" represents the stem II region of an HH ribozyme.
auggauaacugaugangaaaggaagca

SEQ ID NO: 1039 - DNA, 27 bp; single-stranded, linear
  The letter "N" represents the stem II region of an HH ribozyme.
cauggauacugaugangaaaaggaagc

SEQ ID NO: 1040 - DNA, 27 bp; single-stranded, linear
  The letter "N" represents the stem II region of an HH ribozyme.
acauggaucugaugangaaaaaggaag

SEQ ID NO: 1041 - DNA, 27 bp; single-stranded, linear
  The letter "N" represents the stem II region of an HH ribozyme.
uacauggacugaugangaaaaaaggaa

SEQ ID NO: 1042 - DNA, 27 bp; single-stranded, linear
  The letter "N" represents the stem II region of an HH ribozyme.
auuacaugcugaugangaaauaaaagg

SEQ ID NO: 1043 - DNA, 27 bp; single-stranded, linear
  The letter "N" represents the stem II region of an HH ribozyme.
aguuaaaucugaugangaaacauggau

SEQ ID NO: 1044 - DNA, 27 bp; single-stranded, linear
  The letter "N" represents the stem II region of an HH ribozyme.
uacaguuacugaugangaaauuacaug

SEQ ID NO: 1045 - DNA, 27 bp; single-stranded, linear
  The letter "N" represents the stem II region of an HH ribozyme.
cuacaguucugaugangaaaauuacau

SEQ ID NO: 1046 - DNA, 27 bp; single-stranded, linear
  The letter "N" represents the stem II region of an HH ribozyme.
ucuacagucugaugangaaaaauuaca

SEQ ID NO: 1047 - DNA, 27 bp; single-stranded, linear
  The letter "N" represents the stem II region of an HH ribozyme.
ucagguuccugaugangaaacaguuaa

SEQ ID NO: 1048 - DNA, 27 bp; single-stranded, linear
  The letter "N" represents the stem II region of an HH ribozyme.
guuacuuacugaugangaaagcucagg

SEQ ID NO: 1049 - DNA, 27 bp; single-stranded, linear
  The letter "N" represents the stem II region of an HH ribozyme.
cgguuacucugaugangaaagagcuca

SEQ ID NO: 1050 - DNA, 27 bp; single-stranded, linear
  The letter "N" represents the stem II region of an HH ribozyme.
ucuucggucugaugangaaacuuagag

SEQ ID NO: 1051 - DNA, 27 bp; single-stranded, linear
  The letter "N" represents the stem II region of an HH ribozyme.
cagaggcacugaugangaaacauucuu

SEQ ID NO: 1052 - DNA, 27 bp; single-stranded, linear
  The letter "N" represents the stem II region of an HH ribozyme.
uaagaacacugaugangaaaggcauac

SEQ ID NO: 1053 - DNA, 27 bp; single-stranded, linear
  The letter "N" represents the stem II region of an HH ribozyme.
cacauaagcugaugangaaacagaggc

SEQ ID NO: 1054 - DNA, 27 bp; single-stranded, linear
  The letter "N" represents the stem II region of an HH ribozyme.
gcacauaacugaugangaaaacagagg

SEQ ID NO: 1055 - DNA, 27 bp; single-stranded, linear
  The letter "N" represents the stem II region of an HH ribozyme.
uggcacaucugaugangaaagaacaga

SEQ ID NO: 1056 - DNA, 27 bp; single-stranded, linear
  The letter "N" represents the stem II region of an HH ribozyme.
guggcacacugaugangaaaagaacag

SEQ ID NO: 1057 - DNA, 27 bp; single-stranded, linear
  The letter "N" represents the stem II region of an HH ribozyme.
uaaacaagcugaugangaaauguggca

SEQ ID NO: 1058 - DNA, 27 bp; single-stranded, linear
  The letter "N" represents the stem II region of an HH ribozyme.
cuuuaaaccugaugangaaaggaugug

SEQ ID NO: 1059 - DNA, 27 bp; single-stranded, linear
  The letter "N" represents the stem II region of an HH ribozyme.
agccuuuacugaugangaaacaaggau

SEQ ID NO: 1060 - DNA, 27 bp; single-stranded, linear
  The letter "N" represents the stem II region of an HH ribozyme.
gagccuuucugaugangaaaacaagga

SEQ ID NO: 1061 - DNA, 27 bp; single-stranded, linear
  The letter "N" represents the stem II region of an HH ribozyme.
agagccuucugaugangaaaaacaagg

SEQ ID NO: 1062 - DNA, 27 bp; single-stranded, linear
  The letter "N" represents the stem II region of an HH ribozyme.
cauacagacugaugangaaagccuuua

SEQ ID NO: 1063 - DNA, 27 bp; single-stranded, linear
  The letter "N" represents the stem II region of an HH ribozyme.
uucauacacugaugangaaagagccuu

SEQ ID NO: 1064 - DNA, 27 bp; single-stranded, linear
  The letter "N" represents the stem II region of an HH ribozyme.
ucucuucacugaugangaaacagagag

SEQ ID NO: 1065 - DNA, 27 bp; single-stranded, linear
  The letter "N" represents the stem II region of an HH ribozyme.
gugcugaucugaugangaaacgguccc

SEQ ID NO: 1066 - DNA, 27 bp; single-stranded, linear
  The letter "N" represents the stem II region of an HH ribozyme.
aaugugcucugaugangaaaugacggu

SEQ ID NO: 1067 - DNA, 27 bp; single-stranded, linear
  The letter "N" represents the stem II region of an HH ribozyme.
cacuagggcugaugangaaaugugcug

SEQ ID NO: 1068 - DNA, 27 bp; single-stranded, linear
  The letter "N" represents the stem II region of an HH ribozyme.
ucacuaggcugaugangaaaaugugcu

SEQ ID NO: 1069 - DNA, 27 bp; single-stranded, linear
  The letter "N" represents the stem II region of an HH ribozyme.
aggcucaccugaugangaaagggaaug

SEQ ID NO: 1070 - DNA, 27 bp; single-stranded, linear
  The letter "N" represents the stem II region of an HH ribozyme.
ggagccagcugaugangaaaggcucac

SEQ ID NO: 1071 - DNA, 27 bp; single-stranded, linear
  The letter "N" represents the stem II region of an HH ribozyme.
gcugccagcugaugangaaagccagua

SEQ ID NO: 1072 - DNA, 27 bp; single-stranded, linear
  The letter "N" represents the stem II region of an HH ribozyme.
uuccacaacugaugangaaagccgcug

SEQ ID NO: 1073 - DNA, 27 bp; single-stranded, linear
  The letter "N" represents the stem II region of an HH ribozyme.
cuuccacacugaugangaaaagccgcu

SEQ ID NO: 1074 - DNA, 27 bp; single-stranded, linear
  The letter "N" represents the stem II region of an HH ribozyme.
ucuuccaccugaugangaaaaagccgc

SEQ ID NO: 1075 - DNA, 27 bp; single-stranded, linear
  The letter "N" represents the stem II region of an HH ribozyme.
uggcuagucugaugangaaagucuucc

SEQ ID NO: 1076 - DNA, 27 bp; single-stranded, linear
  The letter "N" represents the stem II region of an HH ribozyme.
cuucuggccugaugangaaagugaguc

SEQ ID NO: 1077 - DNA, 27 bp; single-stranded, linear
  The letter "N" represents the stem II region of an HH ribozyme.
guggagagcugaugangaaacuguccc

SEQ ID NO: 1078 - DNA, 27 bp; single-stranded, linear
  The letter "N" represents the stem II region of an HH ribozyme.
uugguggacugaugangaaaggacugu

SEQ ID NO: 1079 - DNA, 27 bp; single-stranded, linear
  The letter "N" represents the stem II region of an HH ribozyme.
ucuuggugcugaugangaaagaggacu

SEQ ID NO: 1080 - DNA, 27 bp; single-stranded, linear
  The letter "N" represents the stem II region of an HH ribozyme.
uggauuuacugaugangaaaucuuggu

SEQ ID NO: 1081 - DNA, 27 bp; single-stranded, linear
  The letter "N" represents the stem II region of an HH ribozyme.
uuuggauucugaugangaaagaucuug

SEQ ID NO: 1082 - DNA, 27 bp; single-stranded, linear
  The letter "N" represents the stem II region of an HH ribozyme.
uuuguuugcugaugangaaauuuagau

SEQ ID NO: 1083 - DNA, 27 bp; single-stranded, linear
  The letter "N" represents the stem II region of an HH ribozyme.
ucuggcuccugaugangaaagccugcu

SEQ ID NO: 1084 - DNA, 27 bp; single-stranded, linear
  The letter "N" represents the stem II region of an HH ribozyme.
acaacaaacugaugangaaauuugucc

SEQ ID NO: 1085 - DNA, 27 bp; single-stranded, linear
  The letter "N" represents the stem II region of an HH ribozyme.
gaacaacacugaugangaaagauuugu

SEQ ID NO: 1086 - DNA, 27 bp; single-stranded, linear
  The letter "N" represents the stem II region of an HH ribozyme.
ggaacaaccugaugangaaaagauuug

SEQ ID NO: 1087 - DNA, 27 bp; single-stranded, linear
  The letter "N" represents the stem II region of an HH ribozyme.
agaggaaccugaugangaaacaaagau

SEQ ID NO: 1088 - DNA, 27 bp; single-stranded, linear
  The letter "N" represents the stem II region of an HH ribozyme.
agaagaggcugaugangaaacaacaaa

SEQ ID NO: 1089 - DNA, 27 bp; single-stranded, linear
  The letter "N" represents the stem II region of an HH ribozyme.
aagaagagcugaugangaaaacaacaa

SEQ ID NO: 1090 - DNA, 27 bp; single-stranded, linear
  The letter "N" represents the stem II region of an HH ribozyme.
guaaagaacugaugangaaaggaacaa

SEQ ID NO: 1091 - DNA, 27 bp; single-stranded, linear
  The letter "N" represents the stem II region of an HH ribozyme.
guguaaagcugaugangaaagaggaac

SEQ ID NO: 1092 - DNA, 27 bp; single-stranded, linear
  The letter "N" represents the stem II region of an HH ribozyme.
uguguaaacugaugangaaaagaggaa

SEQ ID NO: 1093 - DNA, 27 bp; single-stranded, linear
  The letter "N" represents the stem II region of an HH ribozyme.
uauguguacugaugangaaagaagagg

SEQ ID NO: 1094 - DNA, 27 bp; single-stranded, linear
  The letter "N" represents the stem II region of an HH ribozyme.
guaugugucugaugangaaaagaagag

SEQ ID NO: 1095 - DNA, 27 bp; single-stranded, linear
  The letter "N" represents the stem II region of an HH ribozyme.
cguaugugcugaugangaaaaagaaga

SEQ ID NO: 1096 - DNA, 27 bp; single-stranded, linear
  The letter "N" represents the stem II region of an HH ribozyme.
gguuugcgcugaugangaaauguguaa

SEQ ID NO: 1097 - DNA, 27 bp; single-stranded, linear
  The letter "N" represents the stem II region of an HH ribozyme.
auuuauaacugaugangaaauugccag

SEQ ID NO: 1098 - DNA, 27 bp; single-stranded, linear
  The letter "N" represents the stem II region of an HH ribozyme.
gauuuauacugaugangaaaauugcca

SEQ ID NO: 1099 - DNA, 27 bp; single-stranded, linear
  The letter "N" represents the stem II region of an HH ribozyme.
ugauuuaucugaugangaaaaauugcc

SEQ ID NO: 1100 - DNA, 27 bp; single-stranded, linear
  The letter "N" represents the stem II region of an HH ribozyme.
cugauuuacugaugangaaaaaauugc

SEQ ID NO: 1101 - DNA, 27 bp; single-stranded, linear
  The letter "N" represents the stem II region of an HH ribozyme.
accugauucugaugangaaauaaaauu

SEQ ID NO: 1102 - DNA, 27 bp; single-stranded, linear
  The letter "N" represents the stem II region of an HH ribozyme.
aguuaccucugaugangaaauuuauaa

SEQ ID NO: 1103 - DNA, 27 bp; single-stranded, linear
  The letter "N" represents the stem II region of an HH ribozyme.
cuuccagucugaugangaaaccugauu

SEQ ID NO: 1104 - DNA, 27 bp; single-stranded, linear
  The letter "N" represents the stem II region of an HH ribozyme.
cugaguuucugaugangaaaccuccuu

SEQ ID NO: 1105 - DNA, 27 bp; single-stranded, linear
  The letter "N" represents the stem II region of an HH ribozyme.
ucugaguucugaugangaaaaccuccu

SEQ ID NO: 1106 - DNA, 27 bp; single-stranded, linear
  The letter "N" represents the stem II region of an HH ribozyme.
uuuuuucucugaugangaaaguuuaac

SEQ ID NO: 1107 - DNA, 27 bp; single-stranded, linear
  The letter "N" represents the stem II region of an HH ribozyme.
aauugacucugaugangaaaggucuuc

SEQ ID NO: 1108 - DNA, 27 bp; single-stranded, linear
  The letter "N" represents the stem II region of an HH ribozyme.
agagaauucugaugangaaacugaggu

SEQ ID NO: 1109 - DNA, 27 bp; single-stranded, linear
  The letter "N" represents the stem II region of an HH ribozyme.
aaguagagcugaugangaaauugacug

SEQ ID NO: 1110 - DNA, 27 bp; single-stranded, linear
  The letter "N" represents the stem II region of an HH ribozyme.
aaaguagacugaugangaaaauugacu

SEQ ID NO: 1111 - DNA, 27 bp; single-stranded, linear
  The letter "N" represents the stem II region of an HH ribozyme.
aaaaaguacugaugangaaagaauuga

SEQ ID NO: 1112 - DNA, 27 bp; single-stranded, linear
  The letter "N" represents the stem II region of an HH ribozyme.
aaaaaaagcugaugangaaagagaauu

SEQ ID NO: 1113 - DNA, 27 bp; single-stranded, linear
  The letter "N" represents the stem II region of an HH ribozyme.
aaaaaaaacugaugangaaaguagaga

SEQ ID NO: 1114 - DNA, 27 bp; single-stranded, linear
  The letter "N" represents the stem II region of an HH ribozyme.
aaaaaaaacugaugangaaaaguagag

SEQ ID NO: 1115 - DNA, 27 bp; single-stranded, linear
  The letter "N" represents the stem II region of an HH ribozyme.
aaaaaaaacugaugangaaaaaguaga

SEQ ID NO: 1116 - DNA, 27 bp; single-stranded, linear
  The letter "N" represents the stem II region of an HH ribozyme.
aaaaaaaacugaugangaaaaaaguag

SEQ ID NO: 1117 - DNA, 27 bp; single-stranded, linear
  The letter "N" represents the stem II region of an HH ribozyme.
aaaaaaaacugaugangaaaaaaagua

SEQ ID NO: 1118 - DNA, 27 bp; single-stranded, linear
  The letter "N" represents the stem II region of an HH ribozyme.
aaaaaaaacugaugangaaaaaaaagu

SEQ ID NO: 1119 - DNA, 27 bp; single-stranded, linear
  The letter "N" represents the stem II region of an HH ribozyme.
aaaaaaaacugaugangaaaaaaaaag

SEQ ID NO: 1120 - DNA, 27 bp; single-stranded, linear
  The letter "N" represents the stem II region of an HH ribozyme.
gaaaaaaacugaugangaaaaaaaaaa

SEQ ID NO: 1121 - DNA, 27 bp; single-stranded, linear
  The letter "N" represents the stem II region of an HH ribozyme.
ggaaaaaacugaugangaaaaaaaaaa

SEQ ID NO: 1122 - DNA, 27 bp; single-stranded, linear
  The letter "N" represents the stem II region of an HH ribozyme.
uggaaaaacugaugangaaaaaaaaaa

SEQ ID NO: 1123 - DNA, 27 bp; single-stranded, linear
  The letter "N" represents the stem II region of an HH ribozyme.
uuggaaaacugaugangaaaaaaaaaa

SEQ ID NO: 1124 - DNA, 27 bp; single-stranded, linear
  The letter "N" represents the stem II region of an HH ribozyme.
uuuggaaacugaugangaaaaaaaaaa

SEQ ID NO: 1125 - DNA, 27 bp; single-stranded, linear
  The letter "N" represents the stem II region of an HH ribozyme.
auuuggaacugaugangaaaaaaaaaa

SEQ ID NO: 1126 - DNA, 27 bp; single-stranded, linear
  The letter "N" represents the stem II region of an HH ribozyme.
gauuuggacugaugangaaaaaaaaaa

SEQ ID NO: 1127 - DNA, 27 bp; single-stranded, linear
  The letter "N" represents the stem II region of an HH ribozyme.
ugauuuggcugaugangaaaaaaaaaa

SEQ ID NO: 1128 - DNA, 27 bp; single-stranded, linear
  The letter "N" represents the stem II region of an HH ribozyme.
cugauuugcugaugangaaaaaaaaaa

SEQ ID NO: 1129 - DNA, 27 bp; single-stranded, linear
  The letter "N" represents the stem II region of an HH ribozyme.
uauuaucucugaugangaaauuuggaa

SEQ ID NO: 1130 - DNA, 27 bp; single-stranded, linear
  The letter "N" represents the stem II region of an HH ribozyme.
ugggcuaucugaugangaaaucugauu

SEQ ID NO: 1131 - DNA, 27 bp; single-stranded, linear
  The letter "N" represents the stem II region of an HH ribozyme.
ugcugggccugaugangaaauuaucug

SEQ ID NO: 1132 - DNA, 27 bp; single-stranded, linear
  The letter "N" represents the stem II region of an HH ribozyme.
guuaucaccugaugangaaauuugcug

SEQ ID NO: 1133 - DNA, 27 bp; single-stranded, linear
  The letter "N" represents the stem II region of an HH ribozyme.
uuauuugucugaugangaaaucacuau

SEQ ID NO: 1134 - DNA, 27 bp; single-stranded, linear
  The letter "N" represents the stem II region of an HH ribozyme.
uaagguuucugaugangaaauuuguua

SEQ ID NO: 1135 - DNA, 27 bp; single-stranded, linear
  The letter "N" represents the stem II region of an HH ribozyme.
gaacagcucugaugangaaagguuuua

SEQ ID NO: 1136 - DNA, 27 bp; single-stranded, linear
  The letter "N" represents the stem II region of an HH ribozyme.
ugaacagccugaugangaaaagguuuu

SEQ ID NO: 1137 - DNA, 27 bp; single-stranded, linear
  The letter "N" represents the stem II region of an HH ribozyme.
aagacaugcugaugangaaacagcuaa

SEQ ID NO: 1138 - DNA, 27 bp; single-stranded, linear
  The letter "N" represents the stem II region of an HH ribozyme.
caagacaucugaugangaaaacagcua

SEQ ID NO: 1139 - DNA, 27 bp; single-stranded, linear
  The letter "N" represents the stem II region of an HH ribozyme.
gaaaucaacugaugangaaacaugaac

SEQ ID NO: 1140 - DNA, 27 bp; single-stranded, linear
  The letter "N" represents the stem II region of an HH ribozyme.
uugaaauccugaugangaaagacauga

SEQ ID NO: 1141 - DNA, 27 bp; single-stranded, linear
  The letter "N" represents the stem II region of an HH ribozyme.
auuauugacugaugangaaaucaagac

SEQ ID NO: 1142 - DNA, 27 bp; single-stranded, linear
  The letter "N" represents the stem II region of an HH ribozyme.
aauuauugcugaugangaaaaucaaga

SEQ ID NO: 1143 - DNA, 27 bp; single-stranded, linear
  The letter "N" represents the stem II region of an HH ribozyme.
uaauuauucugaugangaaaaaucaag

SEQ ID NO: 1144 - DNA, 27 bp; single-stranded, linear
  The letter "N" represents the stem II region of an HH ribozyme.
gaauuaaucugaugangaaauugaaau

SEQ ID NO: 1145 - DNA, 27 bp; single-stranded, linear
  The letter "N" represents the stem II region of an HH ribozyme.
uaagaauucugaugangaaauuauuga

SEQ ID NO: 1146 - DNA, 27 bp; single-stranded, linear
  The letter "N" represents the stem II region of an HH ribozyme.
uuaagaaucugaugangaaaauuauug

SEQ ID NO: 1147 - DNA, 27 bp; single-stranded, linear
  The letter "N" represents the stem II region of an HH ribozyme.
ugauuaagcugaugangaaauuaauua

SEQ ID NO: 1148 - DNA, 27 bp; single-stranded, linear
  The letter "N" represents the stem II region of an HH ribozyme.
augauuaacugaugangaaaauuaauu

SEQ ID NO: 1149 - DNA, 27 bp; single-stranded, linear
  The letter "N" represents the stem II region of an HH ribozyme.
uaaugauucugaugangaaagaauuaa

SEQ ID NO: 1150 - DNA, 27 bp; single-stranded, linear
  The letter "N" represents the stem II region of an HH ribozyme.
uuaaugaucugaugangaaaagaauua

SEQ ID NO: 1151 - DNA, 27 bp; single-stranded, linear
  The letter "N" represents the stem II region of an HH ribozyme.
cucuuaaucugaugangaaauuaagaa

SEQ ID NO: 1152 - DNA, 27 bp; single-stranded, linear
  The letter "N" represents the stem II region of an HH ribozyme.
ggucucuucugaugangaaaugauuaa

SEQ ID NO: 1153 - DNA, 27 bp; single-stranded, linear
  The letter "N" represents the stem II region of an HH ribozyme.
uggucucucugaugangaaaaugauua

SEQ ID NO: 1154 - DNA, 27 bp; single-stranded, linear
  The letter "N" represents the stem II region of an HH ribozyme.
guauuuaucugaugangaaauggucuc

SEQ ID NO: 1155 - DNA, 27 bp; single-stranded, linear
  The letter "N" represents the stem II region of an HH ribozyme.
ggaguauucugaugangaaauuauggu

SEQ ID NO: 1156 - DNA, 27 bp; single-stranded, linear
  The letter "N" represents the stem II region of an HH ribozyme.
aaaaggagcugaugangaaauuuauua

SEQ ID NO: 1157 - DNA, 27 bp; single-stranded, linear
  The letter "N" represents the stem II region of an HH ribozyme.
uugaaaagcugaugangaaaguauuua

SEQ ID NO: 1158 - DNA, 27 bp; single-stranded, linear
  The letter "N" represents the stem II region of an HH ribozyme.
cucuugaacugaugangaaaggaguau

SEQ ID NO: 1159 - DNA, 27 bp; single-stranded, linear
  The letter "N" represents the stem II region of an HH ribozyme.
ucucuugacugaugangaaaaggagua

SEQ ID NO: 1160 - DNA, 27 bp; single-stranded, linear
  The letter "N" represents the stem II region of an HH ribozyme.
uucucuugcugaugangaaaaaggagu

SEQ ID NO: 1161 - DNA, 27 bp; single-stranded, linear
  The letter "N" represents the stem II region of an HH ribozyme.
uuucucuucugaugangaaaaaaggag

SEQ ID NO: 1162 - DNA, 27 bp; single-stranded, linear
  The letter "N" represents the stem II region of an HH ribozyme.
acaauucucugaugangaaaugguuuu

SEQ ID NO: 1163 - DNA, 27 bp; single-stranded, linear
  The letter "N" represents the stem II region of an HH ribozyme.
aacaauuccugaugangaaaaugguuu

SEQ ID NO: 1164 - DNA, 27 bp; single-stranded, linear
  The letter "N" represents the stem II region of an HH ribozyme.
ugaguaaccugaugangaaauucuaau

SEQ ID NO: 1165 - DNA, 27 bp; single-stranded, linear
  The letter "N" represents the stem II region of an HH ribozyme.
agcugagucugaugangaaacaauucu

SEQ ID NO: 1166 - DNA, 27 bp; single-stranded, linear
  The letter "N" represents the stem II region of an HH ribozyme.
gagcugagcugaugangaaaacaauuc

SEQ ID NO: 1167 - DNA, 27 bp; single-stranded, linear
  The letter "N" represents the stem II region of an HH ribozyme.
aaggagcucugaugangaaaguaacaa

SEQ ID NO: 1168 - DNA, 27 bp; single-stranded, linear
  The letter "N" represents the stem II region of an HH ribozyme.
guuugaagcugaugangaaagcugagu

SEQ ID NO: 1169 - DNA, 27 bp; single-stranded, linear
  The letter "N" represents the stem II region of an HH ribozyme.
ugaguuugcugaugangaaaggagcug

SEQ ID NO: 1170 - DNA, 27 bp; single-stranded, linear
  The letter "N" represents the stem II region of an HH ribozyme.
cugaguuucugaugangaaaaggagcu

SEQ ID NO: 1171 - DNA, 27 bp; single-stranded, linear
  The letter "N" represents the stem II region of an HH ribozyme.
acaaaccucugaugangaaaguuugaa

SEQ ID NO: 1172 - DNA, 27 bp; single-stranded, linear
  The letter "N" represents the stem II region of an HH ribozyme.
augcuacacugaugangaaaccugagu

SEQ ID NO: 1173 - DNA, 27 bp; single-stranded, linear
  The letter "N" represents the stem II region of an HH ribozyme.
uaugcuaccugaugangaaaaccugag

SEQ ID NO: 1174 - DNA, 27 bp; single-stranded, linear
  The letter "N" represents the stem II region of an HH ribozyme.
auguaugccugaugangaaacaaaccu

SEQ ID NO: 1175 - DNA, 27 bp; single-stranded, linear
  The letter "N" represents the stem II region of an HH ribozyme.
gacucaugcugaugangaaaugcuaca

SEQ ID NO: 1176 - DNA, 27 bp; single-stranded, linear
  The letter "N" represents the stem II region of an HH ribozyme.
gauggaugcugaugangaaacucaugu

SEQ ID NO: 1177 - DNA, 27 bp; single-stranded, linear
  The letter "N" represents the stem II region of an HH ribozyme.
gacugaugcugaugangaaauggacuc

SEQ ID NO: 1178 - DNA, 27 bp; single-stranded, linear
  The letter "N" represents the stem II region of an HH ribozyme.
cuuugacucugaugangaaauggaugg

SEQ ID NO: 1179 - DNA, 27 bp; single-stranded, linear
  The letter "N" represents the stem II region of an HH ribozyme.
cauucuuucugaugangaaacugaugg

SEQ ID NO: 1180 - DNA, 27 bp; single-stranded, linear
  The letter "N" represents the stem II region of an HH ribozyme.
ccagauggcugaugangaaaccauucu

SEQ ID NO: 1181 - DNA, 27 bp; single-stranded, linear
  The letter "N" represents the stem II region of an HH ribozyme.
uccagaugcugaugangaaaaccauuc

SEQ ID NO: 1182 - DNA, 27 bp; single-stranded, linear
  The letter "N" represents the stem II region of an HH ribozyme.
agacuccacugaugangaaauggaacc

SEQ ID NO: 1183 - DNA, 27 bp; single-stranded, linear
  The letter "N" represents the stem II region of an HH ribozyme.
uacauuaacugaugangaaacuccaga

SEQ ID NO: 1184 - DNA, 27 bp; single-stranded, linear
  The letter "N" represents the stem II region of an HH ribozyme.
ucuacauucugaugangaaagacucca

SEQ ID NO: 1185 - DNA, 27 bp; single-stranded, linear
  The letter "N" represents the stem II region of an HH ribozyme.
uucuacaucugaugangaaaagacucc

SEQ ID NO: 1186 - DNA, 27 bp; single-stranded, linear
  The letter "N" represents the stem II region of an HH ribozyme.
uuucuuuccugaugangaaacauuaag

SEQ ID NO: 1187 - DNA, 27 bp; single-stranded, linear
  The letter "N" represents the stem II region of an HH ribozyme.
auuauuaccugaugangaaagucucca

SEQ ID NO: 1188 - DNA, 27 bp; single-stranded, linear
  The letter "N" represents the stem II region of an HH ribozyme.
cucauuaucugaugangaaacaagucu

SEQ ID NO: 1189 - DNA, 27 bp; single-stranded, linear
  The letter "N" represents the stem II region of an HH ribozyme.
uagcucaucugaugangaaauuacaag

SEQ ID NO: 1190 - DNA, 27 bp; single-stranded, linear
  The letter "N" represents the stem II region of an HH ribozyme.
uuuguaaccugaugangaaagcucauu

SEQ ID NO: 1191 - DNA, 27 bp; single-stranded, linear
  The letter "N" represents the stem II region of an HH ribozyme.
cacuuugucugaugangaaacuagcuc

SEQ ID NO: 1192 - DNA, 27 bp; single-stranded, linear
  The letter "N" represents the stem II region of an HH ribozyme.
gcacuuugcugaugangaaaacuagcu

SEQ ID NO: 1193 - DNA, 27 bp; single-stranded, linear
  The letter "N" represents the stem II region of an HH ribozyme.
uaaugaaccugaugangaaagcacuuu

SEQ ID NO: 1194 - DNA, 27 bp; single-stranded, linear
  The letter "N" represents the stem II region of an HH ribozyme.
uuuuaaugcugaugangaaacaagcac

SEQ ID NO: 1195 - DNA, 27 bp; single-stranded, linear
  The letter "N" represents the stem II region of an HH ribozyme.
auuuuaaucugaugangaaaacaagca

SEQ ID NO: 1196 - DNA, 27 bp; single-stranded, linear
  The letter "N" represents the stem II region of an HH ribozyme.
gcuauuuucugaugangaaaugaacaa

SEQ ID NO: 1197 - DNA, 27 bp; single-stranded, linear
  The letter "N" represents the stem II region of an HH ribozyme.
ugcuauuucugaugangaaaaugaaca

SEQ ID NO: 1198 - DNA, 27 bp; single-stranded, linear
  The letter "N" represents the stem II region of an HH ribozyme.
uucagugccugaugangaaauuuuaau

SEQ ID NO: 1199 - DNA, 27 bp; single-stranded, linear
  The letter "N" represents the stem II region of an HH ribozyme.
cauguuuccugaugangaaauuuucag

SEQ ID NO: 1200 - DNA, 27 bp; single-stranded, linear
  The letter "N" represents the stem II region of an HH ribozyme.
uaucaguucugaugangaaauucaugu

SEQ ID NO: 1201 - DNA, 27 bp; single-stranded, linear
  The letter "N" represents the stem II region of an HH ribozyme.
uuaucagucugaugangaaaauucaug

SEQ ID NO: 1202 - DNA, 27 bp; single-stranded, linear
  The letter "N" represents the stem II region of an HH ribozyme.
uggaauaucugaugangaaaucaguua

SEQ ID NO: 1203 - DNA, 27 bp; single-stranded, linear
  The letter "N" represents the stem II region of an HH ribozyme.
gauuggaacugaugangaaauuaucag

SEQ ID NO: 1204 - DNA, 27 bp; single-stranded, linear
  The letter "N" represents the stem II region of an HH ribozyme.
augauuggcugaugangaaauauuauc

SEQ ID NO: 1205 - DNA, 27 bp; single-stranded, linear
  The letter "N" represents the stem II region of an HH ribozyme.
aaugauugcugaugangaaaauauuau

SEQ ID NO: 1206 - DNA, 27 bp; single-stranded, linear
  The letter "N" represents the stem II region of an HH ribozyme.
uggcaaaucugaugangaaauuggaau

SEQ ID NO: 1207 - DNA, 27 bp; single-stranded, linear
  The letter "N" represents the stem II region of an HH ribozyme.
aaauggcacugaugangaaaugauugg

SEQ ID NO: 1208 - DNA, 27 bp; single-stranded, linear
  The letter "N" represents the stem II region of an HH ribozyme.
uaaauggccugaugangaaaaugauug

SEQ ID NO: 1209 - DNA, 27 bp; single-stranded, linear
  The letter "N" represents the stem II region of an HH ribozyme.
uugucauacugaugangaaauggcaaa

SEQ ID NO: 1210 - DNA, 27 bp; single-stranded, linear
  The letter "N" represents the stem II region of an HH ribozyme.
uuugucaucugaugangaaaauggcaa

SEQ ID NO: 1211 - DNA, 27 bp; single-stranded, linear
  The letter "N" represents the stem II region of an HH ribozyme.
uuuugucacugaugangaaaaauggca

SEQ ID NO: 1212 - DNA, 27 bp; single-stranded, linear
  The letter "N" represents the stem II region of an HH ribozyme.
uuagugcccugaugangaaaccauuuu

SEQ ID NO: 1213 - DNA, 27 bp; single-stranded, linear
  The letter "N" represents the stem II region of an HH ribozyme.
uucuuugucugaugangaaagugccaa

SEQ ID NO: 1214 - DNA, 27 bp; single-stranded, linear
  The letter "N" represents the stem II region of an HH ribozyme.
cugaaaggcugaugangaaagugcucg

SEQ ID NO: 1215 - DNA, 27 bp; single-stranded, linear
  The letter "N" represents the stem II region of an HH ribozyme.
ucugaaagcugaugangaaaagugcuc

SEQ ID NO: 1216 - DNA, 27 bp; single-stranded, linear
  The letter "N" represents the stem II region of an HH ribozyme.
aacucugacugaugangaaaggaagug

SEQ ID NO: 1217 - DNA, 27 bp; single-stranded, linear
  The letter "N" represents the stem II region of an HH ribozyme.
aaacucugcugaugangaaaaggaagu

SEQ ID NO: 1218 - DNA, 27 bp; single-stranded, linear
  The letter "N" represents the stem II region of an HH ribozyme.
gaaacucucugaugangaaaaaggaag

SEQ ID NO: 1219 - DNA, 27 bp; single-stranded, linear
  The letter "N" represents the stem II region of an HH ribozyme.
aucucagacugaugangaaacucugaa

SEQ ID NO: 1220 - DNA, 27 bp; single-stranded, linear
  The letter "N" represents the stem II region of an HH ribozyme.
uaucucagcugaugangaaaacucuga

SEQ ID NO: 1221 - DNA, 27 bp; single-stranded, linear
  The letter "N" represents the stem II region of an HH ribozyme.
uuaucucacugaugangaaaaacucug

SEQ ID NO: 1222 - DNA, 27 bp; single-stranded, linear
  The letter "N" represents the stem II region of an HH ribozyme.
acguacaucugaugangaaaucucaga

SEQ ID NO: 1223 - DNA, 27 bp; single-stranded, linear
  The letter "N" represents the stem II region of an HH ribozyme.
guuccacgcugaugangaaacauuauc

SEQ ID NO: 1224 - DNA, 27 bp; single-stranded, linear
  The letter "N" represents the stem II region of an HH ribozyme.
uccacccacugaugangaaacuguucc

SEQ ID NO: 1225 - DNA, 27 bp; single-stranded, linear
  The letter "N" represents the stem II region of an HH ribozyme.
aagacacacugaugangaaacuugcac

SEQ ID NO: 1226 - DNA, 27 bp; single-stranded, linear
  The letter "N" represents the stem II region of an HH ribozyme.
acugacaacugaugangaaacacagac

SEQ ID NO: 1227 - DNA, 27 bp; single-stranded, linear
  The letter "N" represents the stem II region of an HH ribozyme.
ggacugaccugaugangaaagacacag

SEQ ID NO: 1228 - DNA, 27 bp; single-stranded, linear
  The letter "N" represents the stem II region of an HH ribozyme.
cuuggacucugaugangaaacaagaca

SEQ ID NO: 1229 - DNA, 27 bp; single-stranded, linear
  The letter "N" represents the stem II region of an HH ribozyme.
acuucuugcugaugangaaacugacaa

SEQ ID NO: 1230 - DNA, 27 bp; single-stranded, linear
  The letter "N" represents the stem II region of an HH ribozyme.
cuaaaauucugaugangaaacaucucg

SEQ ID NO: 1231 - DNA, 27 bp; single-stranded, linear
  The letter "N" represents the stem II region of an HH ribozyme.
ccuaaaaucugaugangaaaacaucuc

SEQ ID NO: 1232 - DNA, 27 bp; single-stranded, linear
  The letter "N" represents the stem II region of an HH ribozyme.
gucccuaacugaugangaaauuaacau

SEQ ID NO: 1233 - DNA, 27 bp; single-stranded, linear
  The letter "N" represents the stem II region of an HH ribozyme.
ggucccuacugaugangaaaauuaaca

SEQ ID NO: 1234 - DNA, 27 bp; single-stranded, linear
  The letter "N" represents the stem II region of an HH ribozyme.
gggucccucugaugangaaaaauuaac

SEQ ID NO: 1235 - DNA, 27 bp; single-stranded, linear
  The letter "N" represents the stem II region of an HH ribozyme.
cggguccccugaugangaaaaaauuaa

SEQ ID NO: 1236 - DNA, 27 bp; single-stranded, linear
  The letter "N" represents the stem II region of an HH ribozyme.
uaggaaaccugaugangaaaggcacgg

SEQ ID NO: 1237 - DNA, 27 bp; single-stranded, linear
  The letter "N" represents the stem II region of an HH ribozyme.
ggcuaggacugaugangaaacaaggca

SEQ ID NO: 1238 - DNA, 27 bp; single-stranded, linear
  The letter "N" represents the stem II region of an HH ribozyme.
gggcuaggcugaugangaaaacaaggc

SEQ ID NO: 1239 - DNA, 27 bp; single-stranded, linear
  The letter "N" represents the stem II region of an HH ribozyme.
ugggcuagcugaugangaaaaacaagg

SEQ ID NO: 1240 - DNA, 27 bp; single-stranded, linear
  The letter "N" represents the stem II region of an HH ribozyme.
uugugggccugaugangaaaggaaaca

SEQ ID NO: 1241 - DNA, 27 bp; single-stranded, linear
  The letter "N" represents the stem II region of an HH ribozyme.
aucuguuucugaugangaaauguuugc

SEQ ID NO: 1242 - DNA, 27 bp; single-stranded, linear
  The letter "N" represents the stem II region of an HH ribozyme.
cuagcgagcugaugangaaaucuguuu

SEQ ID NO: 1243 - DNA, 27 bp; single-stranded, linear
  The letter "N" represents the stem II region of an HH ribozyme.
aggcuagccugaugangaaaguaucug

SEQ ID NO: 1244 - DNA, 27 bp; single-stranded, linear
  The letter "N" represents the stem II region of an HH ribozyme.
aaugaggccugaugangaaagcgagua

SEQ ID NO: 1245 - DNA, 27 bp; single-stranded, linear
  The letter "N" represents the stem II region of an HH ribozyme.
auuuaaaucugaugangaaaggcuagc

SEQ ID NO: 1246 - DNA, 27 bp; single-stranded, linear
  The letter "N" represents the stem II region of an HH ribozyme.
ucaauuuacugaugangaaaugaggcu

SEQ ID NO: 1247 - DNA, 27 bp; single-stranded, linear
  The letter "N" represents the stem II region of an HH ribozyme.
aucaauuucugaugangaaaaugaggc

SEQ ID NO: 1248 - DNA, 27 bp; single-stranded, linear
  The letter "N" represents the stem II region of an HH ribozyme.
aaucaauucugaugangaaaaaugagg

SEQ ID NO: 1249 - DNA, 27 bp; single-stranded, linear
  The letter "N" represents the stem II region of an HH ribozyme.
cuuuaauccugaugangaaauuuaaau

SEQ ID NO: 1250 - DNA, 27 bp; single-stranded, linear
  The letter "N" represents the stem II region of an HH ribozyme.
ccuccuuucugaugangaaaucaauuu

SEQ ID NO: 1251 - DNA, 27 bp; single-stranded, linear
  The letter "N" represents the stem II region of an HH ribozyme.
uccuccuucugaugangaaaaucaauu

SEQ ID NO: 1252 - DNA, 27 bp; single-stranded, linear
  The letter "N" represents the stem II region of an HH ribozyme.
cggccaaacugaugangaaaugcacuc

SEQ ID NO: 1253 - DNA, 27 bp; single-stranded, linear
  The letter "N" represents the stem II region of an HH ribozyme.
gucggccacugaugangaaagaugcac

SEQ ID NO: 1254 - DNA, 27 bp; single-stranded, linear
  The letter "N" represents the stem II region of an HH ribozyme.
ugucggcccugaugangaaaagaugca

SEQ ID NO: 1255 - DNA, 27 bp; single-stranded, linear
  The letter "N" represents the stem II region of an HH ribozyme.
cacacagucugaugangaaacaccacu

SEQ ID NO: 1256 - DNA, 27 bp; single-stranded, linear
  The letter "N" represents the stem II region of an HH ribozyme.
aacacacacugaugangaaacacccac

SEQ ID NO: 1257 - DNA, 27 bp; single-stranded, linear
  The letter "N" represents the stem II region of an HH ribozyme.
augcacaacugaugangaaacacacau

SEQ ID NO: 1258 - DNA, 27 bp; single-stranded, linear
  The letter "N" represents the stem II region of an HH ribozyme.
uaugcacacugaugangaaaacacaca

SEQ ID NO: 1259 - DNA, 27 bp; single-stranded, linear
  The letter "N" represents the stem II region of an HH ribozyme.
uuaugcaccugaugangaaaaacacac

SEQ ID NO: 1260 - DNA, 27 bp; single-stranded, linear
  The letter "N" represents the stem II region of an HH ribozyme.
uaaauagucugaugangaaaugcacaa

SEQ ID NO: 1261 - DNA, 27 bp; single-stranded, linear
  The letter "N" represents the stem II region of an HH ribozyme.
uccuuaaacugaugangaaaguuaugc

SEQ ID NO: 1262 - DNA, 27 bp; single-stranded, linear
  The letter "N" represents the stem II region of an HH ribozyme.
uuuccuuacugaugangaaauaguuau

SEQ ID NO: 1263 - DNA, 27 bp; single-stranded, linear
  The letter "N" represents the stem II region of an HH ribozyme.
guuuccuucugaugangaaaauaguua

SEQ ID NO: 1264 - DNA, 27 bp; single-stranded, linear
  The letter "N" represents the stem II region of an HH ribozyme.
aguuuccucugaugangaaaaauaguu

SEQ ID NO: 1265 - DNA, 27 bp; single-stranded, linear
  The letter "N" represents the stem II region of an HH ribozyme.
aacuuuaacugaugangaaauuccagu

SEQ ID NO: 1266 - DNA, 27 bp; single-stranded, linear
  The letter "N" represents the stem II region of an HH ribozyme.
uaacuuuacugaugangaaaauuccag

SEQ ID NO: 1267 - DNA, 27 bp; single-stranded, linear
  The letter "N" represents the stem II region of an HH ribozyme.
guaacuuucugaugangaaaaauucca

SEQ ID NO: 1268 - DNA, 27 bp; single-stranded, linear
  The letter "N" represents the stem II region of an HH ribozyme.
aguaacuucugaugangaaaaaauucc

SEQ ID NO: 1269 - DNA, 27 bp; single-stranded, linear
  The letter "N" represents the stem II region of an HH ribozyme.
auaaaagucugaugangaaacuuuaaa

SEQ ID NO: 1270 - DNA, 27 bp; single-stranded, linear
  The letter "N" represents the stem II region of an HH ribozyme.
uauaaaagcugaugangaaaacuuuaa

SEQ ID NO: 1271 - DNA, 27 bp; single-stranded, linear
  The letter "N" represents the stem II region of an HH ribozyme.
uuguauaacugaugangaaaguaacuu

SEQ ID NO: 1272 - DNA, 27 bp; single-stranded, linear
  The letter "N" represents the stem II region of an HH ribozyme.
uuuguauacugaugangaaaaguaacu

SEQ ID NO: 1273 - DNA, 27 bp; single-stranded, linear
  The letter "N" represents the stem II region of an HH ribozyme.
guuuguaucugaugangaaaaaguaac

SEQ ID NO: 1274 - DNA, 27 bp; single-stranded, linear
  The letter "N" represents the stem II region of an HH ribozyme.
gguuuguacugaugangaaaaaaguaa

SEQ ID NO: 1275 - DNA, 27 bp; single-stranded, linear
  The letter "N" represents the stem II region of an HH ribozyme.
uugguuugcugaugangaaauaaaagu

SEQ ID NO: 1276 - DNA, 27 bp; single-stranded, linear
  The letter "N" represents the stem II region of an HH ribozyme.
guagcauacugaugangaaauucuugg

SEQ ID NO: 1277 - DNA, 27 bp; single-stranded, linear
  The letter "N" represents the stem II region of an HH ribozyme.
cuguagcacugaugangaaauauucuu

SEQ ID NO: 1278 - DNA, 27 bp; single-stranded, linear
  The letter "N" represents the stem II region of an HH ribozyme.
uauaucugcugaugangaaagcauaua

SEQ ID NO: 1279 - DNA, 27 bp; single-stranded, linear
  The letter "N" represents the stem II region of an HH ribozyme.
cugucuuacugaugangaaaucuguag

SEQ ID NO: 1280 - DNA, 27 bp; single-stranded, linear
  The letter "N" represents the stem II region of an HH ribozyme.
gucugucucugaugangaaauaucugu

SEQ ID NO: 1281 - DNA, 27 bp; single-stranded, linear
  The letter "N" represents the stem II region of an HH ribozyme.
uaggaccacugaugangaaaccauguc

SEQ ID NO: 1282 - DNA, 27 bp; single-stranded, linear
  The letter "N" represents the stem II region of an HH ribozyme.
auaggacccugaugangaaaaccaugu

SEQ ID NO: 1283 - DNA, 27 bp; single-stranded, linear
  The letter "N" represents the stem II region of an HH ribozyme.
aaauauagcugaugangaaaccaaacc

SEQ ID NO: 1284 - DNA, 27 bp; single-stranded, linear
  The letter "N" represents the stem II region of an HH ribozyme.
uagaaauacugaugangaaaggaccaa

SEQ ID NO: 1285 - DNA, 27 bp; single-stranded, linear
  The letter "N" represents the stem II region of an HH ribozyme.
acuagaaacugaugangaaauaggacc

SEQ ID NO: 1286 - DNA, 27 bp; single-stranded, linear
  The letter "N" represents the stem II region of an HH ribozyme.
ugacuagacugaugangaaauauagga

SEQ ID NO: 1287 - DNA, 27 bp; single-stranded, linear
  The letter "N" represents the stem II region of an HH ribozyme.
augacuagcugaugangaaaauauagg

SEQ ID NO: 1288 - DNA, 27 bp; single-stranded, linear
  The letter "N" represents the stem II region of an HH ribozyme.
caugacuacugaugangaaaaauauag

SEQ ID NO: 1289 - DNA, 27 bp; single-stranded, linear
  The letter "N" represents the stem II region of an HH ribozyme.
aucaugaccugaugangaaagaaauau

SEQ ID NO: 1290 - DNA, 27 bp; single-stranded, linear
  The letter "N" represents the stem II region of an HH ribozyme.
uucaucaucugaugangaaacuagaaa

SEQ ID NO: 1291 - DNA, 27 bp; single-stranded, linear
  The letter "N" represents the stem II region of an HH ribozyme.
auacaaaacugaugangaaacauucau

SEQ ID NO: 1292 - DNA, 27 bp; single-stranded, linear
  The letter "N" represents the stem II region of an HH ribozyme.
guauacaacugaugangaaauacauuc

SEQ ID NO: 1293 - DNA, 27 bp; single-stranded, linear
  The letter "N" represents the stem II region of an HH ribozyme.
gguauacacugaugangaaaauacauu

SEQ ID NO: 1294 - DNA, 27 bp; single-stranded, linear
  The letter "N" represents the stem II region of an HH ribozyme.
ugguauaccugaugangaaaaauacau

SEQ ID NO: 1295 - DNA, 27 bp; single-stranded, linear
  The letter "N" represents the stem II region of an HH ribozyme.
agaugguacugaugangaaacaaaaua

SEQ ID NO: 1296 - DNA, 27 bp; single-stranded, linear
  The letter "N" represents the stem II region of an HH ribozyme.
gaagauggcugaugangaaauacaaaa

SEQ ID NO: 1297 - DNA, 27 bp; single-stranded, linear
  The letter "N" represents the stem II region of an HH ribozyme.
uauaugaacugaugangaaaugguaua

SEQ ID NO: 1298 - DNA, 27 bp; single-stranded, linear
  The letter "N" represents the stem II region of an HH ribozyme.
auuauaugcugaugangaaagauggua

SEQ ID NO: 1299 - DNA, 27 bp; single-stranded, linear
  The letter "N" represents the stem II region of an HH ribozyme.
uauuauaucugaugangaaaagauggu

SEQ ID NO: 1300 - DNA, 27 bp; single-stranded, linear
  The letter "N" represents the stem II region of an HH ribozyme.
guauauuacugaugangaaaugaagau

SEQ ID NO: 1301 - DNA, 27 bp; single-stranded, linear
  The letter "N" represents the stem II region of an HH ribozyme.
aaguauaucugaugangaaauaugaag

SEQ ID NO: 1302 - DNA, 27 bp; single-stranded, linear
  The letter "N" represents the stem II region of an HH ribozyme.
uuuaaguacugaugangaaauuauaug

SEQ ID NO: 1303 - DNA, 27 bp; single-stranded, linear
  The letter "N" represents the stem II region of an HH ribozyme.
uuuuuaagcugaugangaaauauuaua

SEQ ID NO: 1304 - DNA, 27 bp; single-stranded, linear
  The letter "N" represents the stem II region of an HH ribozyme.
auauuuuucugaugangaaaguauauu

SEQ ID NO: 1305 - DNA, 27 bp; single-stranded, linear
  The letter "N" represents the stem II region of an HH ribozyme.
aauauuuucugaugangaaaaguauau

SEQ ID NO: 1306 - DNA, 27 bp; single-stranded, linear
  The letter "N" represents the stem II region of an HH ribozyme.
uuaagaaacugaugangaaauuuuuaa

SEQ ID NO: 1307 - DNA, 27 bp; single-stranded, linear
  The letter "N" represents the stem II region of an HH ribozyme.
aauuaagacugaugangaaauauuuuu

SEQ ID NO: 1308 - DNA, 27 bp; single-stranded, linear
  The letter "N" represents the stem II region of an HH ribozyme.
caauuaagcugaugangaaaauauuuu

SEQ ID NO: 1309 - DNA, 27 bp; single-stranded, linear
  The letter "N" represents the stem II region of an HH ribozyme.
ccaauuaacugaugangaaaaauauuu

SEQ ID NO: 1310 - DNA, 27 bp; single-stranded, linear
  The letter "N" represents the stem II region of an HH ribozyme.
ucccaauucugaugangaaagaaauau

SEQ ID NO: 1311 - DNA, 27 bp; single-stranded, linear
  The letter "N" represents the stem II region of an HH ribozyme.
aucccaaucugaugangaaaagaaaua

SEQ ID NO: 1312 - DNA, 27 bp; single-stranded, linear
  The letter "N" represents the stem II region of an HH ribozyme.
caaauccccugaugangaaauuaagaa

SEQ ID NO: 1313 - DNA, 27 bp; single-stranded, linear
  The letter "N" represents the stem II region of an HH ribozyme.
cgauuacacugaugangaaaucccaau

SEQ ID NO: 1314 - DNA, 27 bp; single-stranded, linear
  The letter "N" represents the stem II region of an HH ribozyme.
acgauuaccugaugangaaaaucccaa

SEQ ID NO: 1315 - DNA, 27 bp; single-stranded, linear
  The letter "N" represents the stem II region of an HH ribozyme.
gguacgaucugaugangaaacaaaucc

SEQ ID NO: 1316 - DNA, 27 bp; single-stranded, linear
  The letter "N" represents the stem II region of an HH ribozyme.
guugguaccugaugangaaauuacaaa

SEQ ID NO: 1317 - DNA, 27 bp; single-stranded, linear
  The letter "N" represents the stem II region of an HH ribozyme.
uaaguuggcugaugangaaacgauuac

SEQ ID NO: 1318 - DNA, 27 bp; single-stranded, linear
  The letter "N" represents the stem II region of an HH ribozyme.
uaucaauucugaugangaaaguuggua

SEQ ID NO: 1319 - DNA, 27 bp; single-stranded, linear
  The letter "N" represents the stem II region of an HH ribozyme.
uuaucaaucugaugangaaaaguuggu

SEQ ID NO: 1320 - DNA, 27 bp; single-stranded, linear
  The letter "N" represents the stem II region of an HH ribozyme.
aguuuauccugaugangaaauuaaguu

SEQ ID NO: 1321 - DNA, 27 bp; single-stranded, linear
  The letter "N" represents the stem II region of an HH ribozyme.
gccaaguucugaugangaaaucaauua

SEQ ID NO: 1322 - DNA, 27 bp; single-stranded, linear
  The letter "N" represents the stem II region of an HH ribozyme.
caguugcccugaugangaaaguuuauc

SEQ ID NO: 1323 - DNA, 27 bp; single-stranded, linear
  The letter "N" represents the stem II region of an HH ribozyme.
gaacauaacugaugangaaagcaguug

SEQ ID NO: 1324 - DNA, 27 bp; single-stranded, linear
  The letter "N" represents the stem II region of an HH ribozyme.
agaacauacugaugangaaaagcaguu

SEQ ID NO: 1325 - DNA, 27 bp; single-stranded, linear
  The letter "N" represents the stem II region of an HH ribozyme.
cagaacaucugaugangaaaaagcagu

SEQ ID NO: 1326 - DNA, 27 bp; single-stranded, linear
  The letter "N" represents the stem II region of an HH ribozyme.
acagaacacugaugangaaaaaagcag

SEQ ID NO: 1327 - DNA, 27 bp; single-stranded, linear
  The letter "N" represents the stem II region of an HH ribozyme.
ggagacagcugaugangaaacauaaaa

SEQ ID NO: 1328 - DNA, 27 bp; single-stranded, linear
  The letter "N" represents the stem II region of an HH ribozyme.
aggagacacugaugangaaaacauaaa

SEQ ID NO: 1329 - DNA, 27 bp; single-stranded, linear
  The letter "N" represents the stem II region of an HH ribozyme.
uggaaggacugaugangaaacagaaca

SEQ ID NO: 1330 - DNA, 27 bp; single-stranded, linear
  The letter "N" represents the stem II region of an HH ribozyme.
uauggaagcugaugangaaagacagaa

SEQ ID NO: 1331 - DNA, 27 bp; single-stranded, linear
  The letter "N" represents the stem II region of an HH ribozyme.
auuuauggcugaugangaaaggagaca

SEQ ID NO: 1332 - DNA, 27 bp; single-stranded, linear
  The letter "N" represents the stem II region of an HH ribozyme.
aauuuaugcugaugangaaaaggagac

SEQ ID NO: 1333 - DNA, 27 bp; single-stranded, linear
  The letter "N" represents the stem II region of an HH ribozyme.
gaaaaauucugaugangaaauggaagg

SEQ ID NO: 1334 - DNA, 27 bp; single-stranded, linear
  The letter "N" represents the stem II region of an HH ribozyme.
uuuugaaacugaugangaaauuuaugg

SEQ ID NO: 1335 - DNA, 27 bp; single-stranded, linear
  The letter "N" represents the stem II region of an HH ribozyme.
auuuugaacugaugangaaaauuuaug

SEQ ID NO: 1336 - DNA, 27 bp; single-stranded, linear
  The letter "N" represents the stem II region of an HH ribozyme.
uauuuugacugaugangaaaaauuuau

SEQ ID NO: 1337 - DNA, 27 bp; single-stranded, linear
  The letter "N" represents the stem II region of an HH ribozyme.
guauuuugcugaugangaaaaaauuua

SEQ ID NO: 1338 - DNA, 27 bp; single-stranded, linear
  The letter "N" represents the stem II region of an HH ribozyme.
aguauuuucugaugangaaaaaaauuu

SEQ ID NO: 1339 - DNA, 27 bp; single-stranded, linear
  The letter "N" represents the stem II region of an HH ribozyme.
ugaauuagcugaugangaaauuuugaa

SEQ ID NO: 1340 - DNA, 27 bp; single-stranded, linear
  The letter "N" represents the stem II region of an HH ribozyme.
uguugaaucugaugangaaaguauuuu

SEQ ID NO: 1341 - DNA, 27 bp; single-stranded, linear
  The letter "N" represents the stem II region of an HH ribozyme.
cuuuguugcugaugangaaauuaguau

SEQ ID NO: 1342 - DNA, 27 bp; single-stranded, linear
  The letter "N" represents the stem II region of an HH ribozyme.
ucuuuguucugaugangaaaauuagua

SEQ ID NO: 1343 - DNA, 27 bp; single-stranded, linear
  The letter "N" represents the stem II region of an HH ribozyme.
aaaaaaaacugaugangaaagcuuuuu

SEQ ID NO: 1344 - DNA, 27 bp; single-stranded, linear
  The letter "N" represents the stem II region of an HH ribozyme.
ggaaaaaacugaugangaaagagcuuu

SEQ ID NO: 1345 - DNA, 27 bp; single-stranded, linear
  The letter "N" represents the stem II region of an HH ribozyme.
aggaaaaacugaugangaaaagagcuu

SEQ ID NO: 1346 - DNA, 27 bp; single-stranded, linear
  The letter "N" represents the stem II region of an HH ribozyme.
uaggaaaacugaugangaaaaagagcu

SEQ ID NO: 1347 - DNA, 27 bp; single-stranded, linear
  The letter "N" represents the stem II region of an HH ribozyme.
uuaggaaacugaugangaaaaaagagc

SEQ ID NO: 1348 - DNA, 27 bp; single-stranded, linear
  The letter "N" represents the stem II region of an HH ribozyme.
uuuaggaacugaugangaaaaaaagag

SEQ ID NO: 1349 - DNA, 27 bp; single-stranded, linear
  The letter "N" represents the stem II region of an HH ribozyme.
uuuuaggacugaugangaaaaaaaaga

SEQ ID NO: 1350 - DNA, 27 bp; single-stranded, linear
  The letter "N" represents the stem II region of an HH ribozyme.
auuuuaggcugaugangaaaaaaaaag

SEQ ID NO: 1351 - DNA, 27 bp; single-stranded, linear
  The letter "N" represents the stem II region of an HH ribozyme.
uauuuuagcugaugangaaaaaaaaaa

SEQ ID NO: 1352 - DNA, 27 bp; single-stranded, linear
  The letter "N" represents the stem II region of an HH ribozyme.
guuuauuucugaugangaaaggaaaaa

SEQ ID NO: 1353 - DNA, 27 bp; single-stranded, linear
  The letter "N" represents the stem II region of an HH ribozyme.
uuugaguucugaugangaaauuuuagg

SEQ ID NO: 1354 - DNA, 27 bp; single-stranded, linear
  The letter "N" represents the stem II region of an HH ribozyme.
auaaauuucugaugangaaaguuuauu

SEQ ID NO: 1355 - DNA, 27 bp; single-stranded, linear
  The letter "N" represents the stem II region of an HH ribozyme.
caaggauacugaugangaaauuugagu

SEQ ID NO: 1356 - DNA, 27 bp; single-stranded, linear
  The letter "N" represents the stem II region of an HH ribozyme.
acaaggaucugaugangaaaauuugag

SEQ ID NO: 1357 - DNA, 27 bp; single-stranded, linear
  The letter "N" represents the stem II region of an HH ribozyme.
aacaaggacugaugangaaaaauuuga

SEQ ID NO: 1358 - DNA, 27 bp; single-stranded, linear
  The letter "N" represents the stem II region of an HH ribozyme.
uaaacaagcugaugangaaauaaauuu

SEQ ID NO: 1359 - DNA, 27 bp; single-stranded, linear
  The letter "N" represents the stem II region of an HH ribozyme.
cucuaaaccugaugangaaaggauaaa

SEQ ID NO: 1360 - DNA, 27 bp; single-stranded, linear
  The letter "N" represents the stem II region of an HH ribozyme.
cugcucuacugaugangaaacaaggau

SEQ ID NO: 1361 - DNA, 27 bp; single-stranded, linear
  The letter "N" represents the stem II region of an HH ribozyme.
ucugcucucugaugangaaaacaagga

SEQ ID NO: 1362 - DNA, 27 bp; single-stranded, linear
  The letter "N" represents the stem II region of an HH ribozyme.
cucugcuccugaugangaaaaacaagg

SEQ ID NO: 1363 - DNA, 27 bp; single-stranded, linear
  The letter "N" represents the stem II region of an HH ribozyme.
uuuuucuucugaugangaaauuuuucu

SEQ ID NO: 1364 - DNA, 27 bp; single-stranded, linear
  The letter "N" represents the stem II region of an HH ribozyme.
guuuuucucugaugangaaaauuuuuc

SEQ ID NO: 1365 - DNA, 27 bp; single-stranded, linear
  The letter "N" represents the stem II region of an HH ribozyme.
ccauuucacugaugangaaaguuuuuc

SEQ ID NO: 1366 - DNA, 27 bp; single-stranded, linear
  The letter "N" represents the stem II region of an HH ribozyme.
accauuuccugaugangaaaaguuuuu

SEQ ID NO: 1367 - DNA, 27 bp; single-stranded, linear
  The letter "N" represents the stem II region of an HH ribozyme.
uuuuuugacugaugangaaaccauuuc

SEQ ID NO: 1368 - DNA, 27 bp; single-stranded, linear
  The letter "N" represents the stem II region of an HH ribozyme.
aauuuuuucugaugangaaagaccauu

SEQ ID NO: 1369 - DNA, 27 bp; single-stranded, linear
  The letter "N" represents the stem II region of an HH ribozyme.
uauuuagccugaugangaaauuuuuug

SEQ ID NO: 1370 - DNA, 27 bp; single-stranded, linear
  The letter "N" represents the stem II region of an HH ribozyme.
aaaauauucugaugangaaagcaauuu

SEQ ID NO: 1371 - DNA, 27 bp; single-stranded, linear
  The letter "N" represents the stem II region of an HH ribozyme.
auugaaaacugaugangaaauuuagca

SEQ ID NO: 1372 - DNA, 27 bp; single-stranded, linear
  The letter "N" represents the stem II region of an HH ribozyme.
ccauugaacugaugangaaauauuuag

SEQ ID NO: 1373 - DNA, 27 bp; single-stranded, linear
  The letter "N" represents the stem II region of an HH ribozyme.
uccauugacugaugangaaaauauuua

SEQ ID NO: 1374 - DNA, 27 bp; single-stranded, linear
  The letter "N" represents the stem II region of an HH ribozyme.
uuccauugcugaugangaaaaauauuu

SEQ ID NO: 1375 - DNA, 27 bp; single-stranded, linear
  The letter "N" represents the stem II region of an HH ribozyme.
uuuccauucugaugangaaaaaauauu

SEQ ID NO: 1376 - DNA, 27 bp; single-stranded, linear
  The letter "N" represents the stem II region of an HH ribozyme.
cuaacauucugaugangaaaguuuucc

SEQ ID NO: 1377 - DNA, 27 bp; single-stranded, linear
  The letter "N" represents the stem II region of an HH ribozyme.
gcuaaacucugaugangaaacauuuag

SEQ ID NO: 1378 - DNA, 27 bp; single-stranded, linear
  The letter "N" represents the stem II region of an HH ribozyme.
agcuaaaccugaugangaaaacauuua

SEQ ID NO: 1379 - DNA, 27 bp; single-stranded, linear
  The letter "N" represents the stem II region of an HH ribozyme.
aucagcuacugaugangaaacuaacau

SEQ ID NO: 1380 - DNA, 27 bp; single-stranded, linear
  The letter "N" represents the stem II region of an HH ribozyme.
aaucagcucugaugangaaaacuaaca

SEQ ID NO: 1381 - DNA, 27 bp; single-stranded, linear
  The letter "N" represents the stem II region of an HH ribozyme.
caaucagccugaugangaaaaacuaac

SEQ ID NO: 1382 - DNA, 27 bp; single-stranded, linear
  The letter "N" represents the stem II region of an HH ribozyme.
ccccauaccugaugangaaaucagcua

SEQ ID NO: 1383 - DNA, 27 bp; single-stranded, linear
  The letter "N" represents the stem II region of an HH ribozyme.
aaaccccacugaugangaaacaaucag

SEQ ID NO: 1384 - DNA, 27 bp; single-stranded, linear
  The letter "N" represents the stem II region of an HH ribozyme.
gguucgaacugaugangaaaccccaua

SEQ ID NO: 1385 - DNA, 27 bp; single-stranded, linear
  The letter "N" represents the stem II region of an HH ribozyme.
agguucgacugaugangaaaaccccau

SEQ ID NO: 1386 - DNA, 27 bp; single-stranded, linear
  The letter "N" represents the stem II region of an HH ribozyme.
aagguucgcugaugangaaaaacccca

SEQ ID NO: 1387 - DNA, 27 bp; single-stranded, linear
  The letter "N" represents the stem II region of an HH ribozyme.
aaagguuccugaugangaaaaaacccc

SEQ ID NO: 1388 - DNA, 27 bp; single-stranded, linear
  The letter "N" represents the stem II region of an HH ribozyme.
aaaagugacugaugangaaagguucga

SEQ ID NO: 1389 - DNA, 27 bp; single-stranded, linear
  The letter "N" represents the stem II region of an HH ribozyme.
aaaaagugcugaugangaaaagguucg

SEQ ID NO: 1390 - DNA, 27 bp; single-stranded, linear
  The letter "N" represents the stem II region of an HH ribozyme.
caaaaagucugaugangaaaaagguuc

SEQ ID NO: 1391 - DNA, 27 bp; single-stranded, linear
  The letter "N" represents the stem II region of an HH ribozyme.
caaacaaacugaugangaaagugaaag

SEQ ID NO: 1392 - DNA, 27 bp; single-stranded, linear
  The letter "N" represents the stem II region of an HH ribozyme.
acaaacaacugaugangaaaagugaaa

SEQ ID NO: 1393 - DNA, 27 bp; single-stranded, linear
  The letter "N" represents the stem II region of an HH ribozyme.
aacaaacacugaugangaaaaagugaa

SEQ ID NO: 1394 - DNA, 27 bp; single-stranded, linear
  The letter "N" represents the stem II region of an HH ribozyme.
aaacaaaccugaugangaaaaaaguga

SEQ ID NO: 1395 - DNA, 27 bp; single-stranded, linear
  The letter "N" represents the stem II region of an HH ribozyme.
guaaaacacugaugangaaacaaaaag

SEQ ID NO: 1396 - DNA, 27 bp; single-stranded, linear
  The letter "N" represents the stem II region of an HH ribozyme.
gguaaaaccugaugangaaaacaaaaa

SEQ ID NO: 1397 - DNA, 27 bp; single-stranded, linear
  The letter "N" represents the stem II region of an HH ribozyme.
auagguaacugaugangaaacaaacaa

SEQ ID NO: 1398 - DNA, 27 bp; single-stranded, linear
  The letter "N" represents the stem II region of an HH ribozyme.
aauagguacugaugangaaaacaaaca

SEQ ID NO: 1399 - DNA, 27 bp; single-stranded, linear
  The letter "N" represents the stem II region of an HH ribozyme.
aaauaggucugaugangaaaaacaaac

SEQ ID NO: 1400 - DNA, 27 bp; single-stranded, linear
  The letter "N" represents the stem II region of an HH ribozyme.
gaaauaggcugaugangaaaaaacaaa

SEQ ID NO: 1401 - DNA, 27 bp; single-stranded, linear
  The letter "N" represents the stem II region of an HH ribozyme.
uugugaaacugaugangaaagguaaaa

SEQ ID NO: 1402 - DNA, 27 bp; single-stranded, linear
  The letter "N" represents the stem II region of an HH ribozyme.
aguugugacugaugangaaauagguaa

SEQ ID NO: 1403 - DNA, 27 bp; single-stranded, linear
  The letter "N" represents the stem II region of an HH ribozyme.
caguugugcugaugangaaaauaggua

SEQ ID NO: 1404 - DNA, 27 bp; single-stranded, linear
  The letter "N" represents the stem II region of an HH ribozyme.
acaguugucugaugangaaaaauaggu

SEQ ID NO: 1405 - DNA, 27 bp; single-stranded, linear
  The letter "N" represents the stem II region of an HH ribozyme.
uggcaauucugaugangaaacacaguu

SEQ ID NO: 1406 - DNA, 27 bp; single-stranded, linear
  The letter "N" represents the stem II region of an HH ribozyme.
uuauuggccugaugangaaauuuacac

SEQ ID NO: 1407 - DNA, 27 bp; single-stranded, linear
  The letter "N" represents the stem II region of an HH ribozyme.
acaggaaucugaugangaaauuggcaa

SEQ ID NO: 1408 - DNA, 27 bp; single-stranded, linear
  The letter "N" represents the stem II region of an HH ribozyme.
uggacaggcugaugangaaauuauugg

SEQ ID NO: 1409 - DNA, 27 bp; single-stranded, linear
  The letter "N" represents the stem II region of an HH ribozyme.
auggacagcugaugangaaaauuauug

SEQ ID NO: 1410 - DNA, 27 bp; single-stranded, linear
  The letter "N" represents the stem II region of an HH ribozyme.
uuuucaugcugaugangaaacaggaau

SEQ ID NO: 1411 - DNA, 27 bp; single-stranded, linear
  The letter "N" represents the stem II region of an HH ribozyme.
cacuggaucugaugangaaauuugcau

SEQ ID NO: 1412 - DNA, 27 bp; single-stranded, linear
  The letter "N" represents the stem II region of an HH ribozyme.
acacuggacugaugangaaaauuugca

SEQ ID NO: 1413 - DNA, 27 bp; single-stranded, linear
  The letter "N" represents the stem II region of an HH ribozyme.
cuacacugcugaugangaaauaauuug

SEQ ID NO: 1414 - DNA, 27 bp; single-stranded, linear
  The letter "N" represents the stem II region of an HH ribozyme.
aauauauccugaugangaaacacugga

SEQ ID NO: 1415 - DNA, 27 bp; single-stranded, linear
  The letter "N" represents the stem II region of an HH ribozyme.
gucaaauacugaugangaaaucuacac

SEQ ID NO: 1416 - DNA, 27 bp; single-stranded, linear
  The letter "N" represents the stem II region of an HH ribozyme.
uggucaaacugaugangaaauaucuac

SEQ ID NO: 1417 - DNA, 27 bp; single-stranded, linear
  The letter "N" represents the stem II region of an HH ribozyme.
gauggucacugaugangaaauauaucu

SEQ ID NO: 1418 - DNA, 27 bp; single-stranded, linear
  The letter "N" represents the stem II region of an HH ribozyme.
ugaugguccugaugangaaaauauauc

SEQ ID NO: 1419 - DNA, 27 bp; single-stranded, linear
  The letter "N" represents the stem II region of an HH ribozyme.
cauagggucugaugangaaauggucaa

SEQ ID NO: 1420 - DNA, 27 bp; single-stranded, linear
  The letter "N" represents the stem II region of an HH ribozyme.
aauauccacugaugangaaagggugau

SEQ ID NO: 1421 - DNA, 27 bp; single-stranded, linear
  The letter "N" represents the stem II region of an HH ribozyme.
cuagccaacugaugangaaauccauag

SEQ ID NO: 1422 - DNA, 27 bp; single-stranded, linear
  The letter "N" represents the stem II region of an HH ribozyme.
aacuagcccugaugangaaauauccau

SEQ ID NO: 1423 - DNA, 27 bp; single-stranded, linear
  The letter "N" represents the stem II region of an HH ribozyme.
ggcaaaaccugaugangaaagccaaua

SEQ ID NO: 1424 - DNA, 27 bp; single-stranded, linear
  The letter "N" represents the stem II region of an HH ribozyme.
aaaggcaacugaugangaaacuagcca

SEQ ID NO: 1425 - DNA, 27 bp; single-stranded, linear
  The letter "N" represents the stem II region of an HH ribozyme.
uaaaggcacugaugangaaaacuagcc

SEQ ID NO: 1426 - DNA, 27 bp; single-stranded, linear
  The letter "N" represents the stem II region of an HH ribozyme.
auaaaggccugaugangaaaaacuagc

SEQ ID NO: 1427 - DNA, 27 bp; single-stranded, linear
  The letter "N" represents the stem II region of an HH ribozyme.
gcuuaauacugaugangaaaggcaaaa

SEQ ID NO: 1428 - DNA, 27 bp; single-stranded, linear
  The letter "N" represents the stem II region of an HH ribozyme.
ugcuuaaucugaugangaaaaggcaaa

SEQ ID NO: 1429 - DNA, 27 bp; single-stranded, linear
  The letter "N" represents the stem II region of an HH ribozyme.
uugcuuaacugaugangaaaaaggcaa

SEQ ID NO: 1430 - DNA, 27 bp; single-stranded, linear
  The letter "N" represents the stem II region of an HH ribozyme.
auuugcuucugaugangaaauaaaggc

SEQ ID NO: 1431 - DNA, 27 bp; single-stranded, linear
  The letter "N" represents the stem II region of an HH ribozyme.
aauuugcucugaugangaaaauaaagg

SEQ ID NO: 1432 - DNA, 27 bp; single-stranded, linear
  The letter "N" represents the stem II region of an HH ribozyme.
cugaaaugcugaugangaaauuugcuu

SEQ ID NO: 1433 - DNA, 27 bp; single-stranded, linear
  The letter "N" represents the stem II region of an HH ribozyme.
gcugaaaucugaugangaaaauuugcu

SEQ ID NO: 1434 - DNA, 27 bp; single-stranded, linear
  The letter "N" represents the stem II region of an HH ribozyme.
caggcugacugaugangaaaugaauuu

SEQ ID NO: 1435 - DNA, 27 bp; single-stranded, linear
  The letter "N" represents the stem II region of an HH ribozyme.
ucaggcugcugaugangaaaaugaauu

SEQ ID NO: 1436 - DNA, 27 bp; single-stranded, linear
  The letter "N" represents the stem II region of an HH ribozyme.
uucaggcucugaugangaaaaaugaau

SEQ ID NO: 1437 - DNA, 27 bp; single-stranded, linear
  The letter "N" represents the stem II region of an HH ribozyme.
uauaggcacugaugangaaacauucag

SEQ ID NO: 1438 - DNA, 27 bp; single-stranded, linear
  The letter "N" represents the stem II region of an HH ribozyme.
agaauauacugaugangaaaggcagac

SEQ ID NO: 1439 - DNA, 27 bp; single-stranded, linear
  The letter "N" represents the stem II region of an HH ribozyme.
agagaauacugaugangaaauaggcag

SEQ ID NO: 1440 - DNA, 27 bp; single-stranded, linear
  The letter "N" represents the stem II region of an HH ribozyme.
gcagagaacugaugangaaauauaggc

SEQ ID NO: 1441 - DNA, 27 bp; single-stranded, linear
  The letter "N" represents the stem II region of an HH ribozyme.
gagcagagcugaugangaaauauauag

SEQ ID NO: 1442 - DNA, 27 bp; single-stranded, linear
  The letter "N" represents the stem II region of an HH ribozyme.
agagcagacugaugangaaaauauaua

SEQ ID NO: 1443 - DNA, 27 bp; single-stranded, linear
  The letter "N" represents the stem II region of an HH ribozyme.
aaagagcacugaugangaaagaauaua

SEQ ID NO: 1444 - DNA, 27 bp; single-stranded, linear
  The letter "N" represents the stem II region of an HH ribozyme.
aauacaaacugaugangaaagcagaga

SEQ ID NO: 1445 - DNA, 27 bp; single-stranded, linear
  The letter "N" represents the stem II region of an HH ribozyme.
agaauacacugaugangaaagagcaga

SEQ ID NO: 1446 - DNA, 27 bp; single-stranded, linear
  The letter "N" represents the stem II region of an HH ribozyme.
gagaauaccugaugangaaaagagcag

SEQ ID NO: 1447 - DNA, 27 bp; single-stranded, linear
  The letter "N" represents the stem II region of an HH ribozyme.
aaggagaacugaugangaaacaaagag

SEQ ID NO: 1448 - DNA, 27 bp; single-stranded, linear
  The letter "N" represents the stem II region of an HH ribozyme.
caaaggagcugaugangaaauacaaag

SEQ ID NO: 1449 - DNA, 27 bp; single-stranded, linear
  The letter "N" represents the stem II region of an HH ribozyme.
ucaaaggacugaugangaaaauacaaa

SEQ ID NO: 1450 - DNA, 27 bp; single-stranded, linear
  The letter "N" represents the stem II region of an HH ribozyme.
guucaaagcugaugangaaagaauaca

SEQ ID NO: 1451 - DNA, 27 bp; single-stranded, linear
  The letter "N" represents the stem II region of an HH ribozyme.
cggguucacugaugangaaaggagaau

SEQ ID NO: 1452 - DNA, 27 bp; single-stranded, linear
  The letter "N" represents the stem II region of an HH ribozyme.
acggguuccugaugangaaaaggagaa

SEQ ID NO: 1453 - DNA, 27 bp; single-stranded, linear
  The letter "N" represents the stem II region of an HH ribozyme.
gauguuuucugaugangaaacggguuc

SEQ ID NO: 1454 - DNA, 27 bp; single-stranded, linear
  The letter "N" represents the stem II region of an HH ribozyme.
ggauguuucugaugangaaaacggguu

SEQ ID NO: 1455 - DNA, 27 bp; single-stranded, linear
  The letter "N" represents the stem II region of an HH ribozyme.
ugccacagcugaugangaaauguuuua

SEQ ID NO: 1456 - DNA, 17 bp; single-stranded, linear
cggacacuccucucggc

SEQ ID NO: 1457 - DNA, 17 bp; single-stranded, linear
acacuccucucggcucc

SEQ ID NO: 1458 - DNA, 17 bp; single-stranded, linear
acuccucucggcuccuc

SEQ ID NO: 1459 - DNA, 17 bp; single-stranded, linear
ucucggcuccuccccgg

SEQ ID NO: 1460 - DNA, 17 bp; single-stranded, linear
cggcuccuccccggcag

SEQ ID NO: 1461 - DNA, 17 bp; single-stranded, linear
cggcggcucggagcggg

SEQ ID NO: 1462 - DNA, 17 bp; single-stranded, linear
agcgggcuccggggcuc

SEQ ID NO: 1463 - DNA, 17 bp; single-stranded, linear
ccggggcucgggugcag

SEQ ID NO: 1464 - DNA, 17 bp; single-stranded, linear
gcgaggauuacccgggg

SEQ ID NO: 1465 - DNA, 17 bp; single-stranded, linear
cgaggauuacccgggga

SEQ ID NO: 1466 - DNA, 17 bp; single-stranded, linear
gaagugguugucuccug

SEQ ID NO: 1467 - DNA, 17 bp; single-stranded, linear
gugguugucuccuggcu

SEQ ID NO: 1468 - DNA, 17 bp; single-stranded, linear
gguugucuccuggcugg

SEQ ID NO: 1469 - DNA, 17 bp; single-stranded, linear
cgggcgcucagggcgcg

SEQ ID NO: 1470 - DNA, 17 bp; single-stranded, linear
gacggacucuggcggcc

SEQ ID NO: 1471 - DNA, 17 bp; single-stranded, linear
ggccgggucguuggccg

SEQ ID NO: 1472 - DNA, 17 bp; single-stranded, linear
cgggucguuggccgggg

SEQ ID NO: 1473 - DNA, 17 bp; single-stranded, linear
ggccgcgucgcgcucac

SEQ ID NO: 1474 - DNA, 17 bp; single-stranded, linear
gucgcgcucaccauggu

SEQ ID NO: 1475 - DNA, 17 bp; single-stranded, linear
accauggucagcuacug

SEQ ID NO: 1476 - DNA, 17 bp; single-stranded, linear
ggucagcuacugggaca

SEQ ID NO: 1477 - DNA, 17 bp; single-stranded, linear
accgggguccugcugug

SEQ ID NO: 1478 - DNA, 17 bp; single-stranded, linear
gcgcugcucagcugucu

SEQ ID NO: 1479 - DNA, 17 bp; single-stranded, linear
ucagcugucugcuucuc

SEQ ID NO: 1480 - DNA, 17 bp; single-stranded, linear
ugucugcuucucacagg

SEQ ID NO: 1481 - DNA, 17 bp; single-stranded, linear
gucugcuucucacagga

SEQ ID NO: 1482 - DNA, 17 bp; single-stranded, linear
cugcuucucacaggauc

SEQ ID NO: 1483 - DNA, 17 bp; single-stranded, linear
cacaggaucuaguucag

SEQ ID NO: 1484 - DNA, 17 bp; single-stranded, linear
caggaucuaguucaggu

SEQ ID NO: 1485 - DNA, 17 bp; single-stranded, linear
gaucuaguucagguuca

SEQ ID NO: 1486 - DNA, 17 bp; single-stranded, linear
aucuaguucagguucaa

SEQ ID NO: 1487 - DNA, 17 bp; single-stranded, linear
guucagguucaaaauua

SEQ ID NO: 1488 - DNA, 17 bp; single-stranded, linear
uucagguucaaaauuaa

SEQ ID NO: 1489 - DNA, 17 bp; single-stranded, linear
uucaaaauuaaaagauc

SEQ ID NO: 1490 - DNA, 17 bp; single-stranded, linear
ucaaaauuaaaagaucc

SEQ ID NO: 1491 - DNA, 17 bp; single-stranded, linear
uaaaagauccugaacug

SEQ ID NO: 1492 - DNA, 17 bp; single-stranded, linear
aacugaguuuaaaaggc

SEQ ID NO: 1493 - DNA, 17 bp; single-stranded, linear
acugaguuuaaaaggca

SEQ ID NO: 1494 - DNA, 17 bp; single-stranded, linear
cugaguuuaaaaggcac

SEQ ID NO: 1495 - DNA, 17 bp; single-stranded, linear
cagcacaucaugcaagc

SEQ ID NO: 1496 - DNA, 17 bp; single-stranded, linear
cacugcaucuccaaugc

SEQ ID NO: 1497 - DNA, 17 bp; single-stranded, linear
cugcaucuccaaugcag

SEQ ID NO: 1498 - DNA, 17 bp; single-stranded, linear
cagcccauaaauggucu

SEQ ID NO: 1499 - DNA, 17 bp; single-stranded, linear
uaaauggucuuugccug

SEQ ID NO: 1500 - DNA, 17 bp; single-stranded, linear
aauggucuuugccugaa

SEQ ID NO: 1501 - DNA, 17 bp; single-stranded, linear
auggucuuugccugaaa

SEQ ID NO: 1502 - DNA, 17 bp; single-stranded, linear
uggugaguaaggaaagc

SEQ ID NO: 1503 - DNA, 17 bp; single-stranded, linear
cugagcauaacuaaauc

SEQ ID NO: 1504 - DNA, 17 bp; single-stranded, linear
gcauaacuaaaucugcc

SEQ ID NO: 1505 - DNA, 17 bp; single-stranded, linear
aacuaaaucugccugug

SEQ ID NO: 1506 - DNA, 17 bp; single-stranded, linear
caaacaauucugcagua

SEQ ID NO: 1507 - DNA, 17 bp; single-stranded, linear
aaacaauucugcaguac

SEQ ID NO: 1508 - DNA, 17 bp; single-stranded, linear
ucugcaguacuuuaacc

SEQ ID NO: 1509 - DNA, 17 bp; single-stranded, linear
gcaguacuuuaaccuug

SEQ ID NO: 1510 - DNA, 17 bp; single-stranded, linear
caguacuuuaaccuuga

SEQ ID NO: 1511 - DNA, 17 bp; single-stranded, linear
aguacuuuaaccuugaa

SEQ ID NO: 1512 - DNA, 17 bp; single-stranded, linear
uuuaaccuugaacacag

SEQ ID NO: 1513 - DNA, 17 bp; single-stranded, linear
acacagcucaagcaaac

SEQ ID NO: 1514 - DNA, 17 bp; single-stranded, linear
cacuggcuucuacagcu

SEQ ID NO: 1515 - DNA, 17 bp; single-stranded, linear
acuggcuucuacagcug

SEQ ID NO: 1516 - DNA, 17 bp; single-stranded, linear
uggcuucuacagcugca

SEQ ID NO: 1517 - DNA, 17 bp; single-stranded, linear
cugcaaauaucuagcug

SEQ ID NO: 1518 - DNA, 17 bp; single-stranded, linear
gcaaauaucuagcugua

SEQ ID NO: 1519 - DNA, 17 bp; single-stranded, linear
aaauaucuagcuguacc

SEQ ID NO: 1520 - DNA, 17 bp; single-stranded, linear
cuagcuguaccuacuuc

SEQ ID NO: 1521 - DNA, 17 bp; single-stranded, linear
cuguaccuacuucaaag

SEQ ID NO: 1522 - DNA, 17 bp; single-stranded, linear
uaccuacuucaaagaag

SEQ ID NO: 1523 - DNA, 17 bp; single-stranded, linear
accuacuucaaagaaga

SEQ ID NO: 1524 - DNA, 17 bp; single-stranded, linear
aacagaaucugcaaucu

SEQ ID NO: 1525 - DNA, 17 bp; single-stranded, linear
ucugcaaucuauauauu

SEQ ID NO: 1526 - DNA, 17 bp; single-stranded, linear
ugcaaucuauauauuua

SEQ ID NO: 1527 - DNA, 17 bp; single-stranded, linear
caaucuauauauuuauu

SEQ ID NO: 1528 - DNA, 17 bp; single-stranded, linear
aucuauauauuuauuag

SEQ ID NO: 1529 - DNA, 17 bp; single-stranded, linear
cuauauauuuauuagug

SEQ ID NO: 1530 - DNA, 17 bp; single-stranded, linear
uauauauuuauuaguga

SEQ ID NO: 1531 - DNA, 17 bp; single-stranded, linear
auauauuuauuagugau

SEQ ID NO: 1532 - DNA, 17 bp; single-stranded, linear
auauuuauuagugauac

SEQ ID NO: 1533 - DNA, 17 bp; single-stranded, linear
uauuuauuagugauaca

SEQ ID NO: 1534 - DNA, 17 bp; single-stranded, linear
uuagugauacagguaga

SEQ ID NO: 1535 - DNA, 17 bp; single-stranded, linear
auacagguagaccuuuc

SEQ ID NO: 1536 - DNA, 17 bp; single-stranded, linear
guagaccuuucguagag

SEQ ID NO: 1537 - DNA, 17 bp; single-stranded, linear
uagaccuuucguagaga

SEQ ID NO: 1538 - DNA, 17 bp; single-stranded, linear
agaccuuucguagagau

SEQ ID NO: 1539 - DNA, 17 bp; single-stranded, linear
ccuuucguagagaugua

SEQ ID NO: 1540 - DNA, 17 bp; single-stranded, linear
agagauguacagugaaa

SEQ ID NO: 1541 - DNA, 17 bp; single-stranded, linear
agugaaauccccgaaau

SEQ ID NO: 1542 - DNA, 17 bp; single-stranded, linear
cccgaaauuauacacau

SEQ ID NO: 1543 - DNA, 17 bp; single-stranded, linear
ccgaaauuauacacaug

SEQ ID NO: 1544 - DNA, 17 bp; single-stranded, linear
gaaauuauacacaugac

SEQ ID NO: 1545 - DNA, 17 bp; single-stranded, linear
agggagcucgucauucc

SEQ ID NO: 1546 - DNA, 17 bp; single-stranded, linear
gagcucgucauucccug

SEQ ID NO: 1547 - DNA, 17 bp; single-stranded, linear
cucgucauucccugccg

SEQ ID NO: 1548 - DNA, 17 bp; single-stranded, linear
ucgucauucccugccgg

SEQ ID NO: 1549 - DNA, 17 bp; single-stranded, linear
ugccggguuacgucacc

SEQ ID NO: 1550 - DNA, 17 bp; single-stranded, linear
gccggguuacgucaccu

SEQ ID NO: 1551 - DNA, 17 bp; single-stranded, linear
gguuacgucaccuaaca

SEQ ID NO: 1552 - DNA, 17 bp; single-stranded, linear
cgucaccuaacaucacu

SEQ ID NO: 1553 - DNA, 17 bp; single-stranded, linear
ccuaacaucacuguuac

SEQ ID NO: 1554 - DNA, 17 bp; single-stranded, linear
aucacuguuacuuuaaa

SEQ ID NO: 1555 - DNA, 17 bp; single-stranded, linear
ucacuguuacuuuaaaa

SEQ ID NO: 1556 - DNA, 17 bp; single-stranded, linear
cuguuacuuuaaaaaag

SEQ ID NO: 1557 - DNA, 17 bp; single-stranded, linear
uguuacuuuaaaaaagu

SEQ ID NO: 1558 - DNA, 17 bp; single-stranded, linear
guuacuuuaaaaaaguu

SEQ ID NO: 1559 - DNA, 17 bp; single-stranded, linear
aaaaaaguuuccacuug

SEQ ID NO: 1560 - DNA, 17 bp; single-stranded, linear
aaaaaguuuccacuuga

SEQ ID NO: 1561 - DNA, 17 bp; single-stranded, linear
aaaaguuuccacuugac

SEQ ID NO: 1562 - DNA, 17 bp; single-stranded, linear
uuuccacuugacacuuu

SEQ ID NO: 1563 - DNA, 17 bp; single-stranded, linear
uugacacuuugaucccu

SEQ ID NO: 1564 - DNA, 17 bp; single-stranded, linear
ugacacuuugaucccug

SEQ ID NO: 1565 - DNA, 17 bp; single-stranded, linear
acuuugaucccugaugg

SEQ ID NO: 1566 - DNA, 17 bp; single-stranded, linear
aaacgcauaaucuggga

SEQ ID NO: 1567 - DNA, 17 bp; single-stranded, linear
cgcauaaucugggacag

SEQ ID NO: 1568 - DNA, 17 bp; single-stranded, linear
gggacaguagaaagggc

SEQ ID NO: 1569 - DNA, 17 bp; single-stranded, linear
aaagggcuucaucauau

SEQ ID NO: 1570 - DNA, 17 bp; single-stranded, linear
aagggcuucaucauauc

SEQ ID NO: 1571 - DNA, 17 bp; single-stranded, linear
ggcuucaucauaucaaa

SEQ ID NO: 1572 - DNA, 17 bp; single-stranded, linear
uucaucauaucaaaugc

SEQ ID NO: 1573 - DNA, 17 bp; single-stranded, linear
caucauaucaaaugcaa

SEQ ID NO: 1574 - DNA, 17 bp; single-stranded, linear
ugcaacguacaaagaaa

SEQ ID NO: 1575 - DNA, 17 bp; single-stranded, linear
aaagaaauagggcuucu

SEQ ID NO: 1576 - DNA, 17 bp; single-stranded, linear
auagggcuucugaccug

SEQ ID NO: 1577 - DNA, 17 bp; single-stranded, linear
uagggcuucugaccugu

SEQ ID NO: 1578 - DNA, 17 bp; single-stranded, linear
gcaacagucaaugggca

SEQ ID NO: 1579 - DNA, 17 bp; single-stranded, linear
augggcauuuguauaag

SEQ ID NO: 1580 - DNA, 17 bp; single-stranded, linear
ugggcauuuguauaaga

SEQ ID NO: 1581 - DNA, 17 bp; single-stranded, linear
gcauuuguauaagacaa

SEQ ID NO: 1582 - DNA, 17 bp; single-stranded, linear
auuuguauaagacaaac

SEQ ID NO: 1583 - DNA, 17 bp; single-stranded, linear
gacaaacuaucucacac

SEQ ID NO: 1584 - DNA, 17 bp; single-stranded, linear
caaacuaucucacacau

SEQ ID NO: 1585 - DNA, 17 bp; single-stranded, linear
aacuaucucacacaucg

SEQ ID NO: 1586 - DNA, 17 bp; single-stranded, linear
ucacacaucgacaaacc

SEQ ID NO: 1587 - DNA, 17 bp; single-stranded, linear
aaaccaauacaaucaua

SEQ ID NO: 1588 - DNA, 17 bp; single-stranded, linear
aauacaaucauagaugu

SEQ ID NO: 1589 - DNA, 17 bp; single-stranded, linear
acaaucauagaugucca

SEQ ID NO: 1590 - DNA, 17 bp; single-stranded, linear
auagauguccaaauaag

SEQ ID NO: 1591 - DNA, 17 bp; single-stranded, linear
guccaaauaagcacacc

SEQ ID NO: 1592 - DNA, 17 bp; single-stranded, linear
cgcccagucaaauuacu

SEQ ID NO: 1593 - DNA, 17 bp; single-stranded, linear
agucaaauuacuuagag

SEQ ID NO: 1594 - DNA, 17 bp; single-stranded, linear
gucaaauuacuuagagg

SEQ ID NO: 1595 - DNA, 17 bp; single-stranded, linear
aaauuacuuagaggcca

SEQ ID NO: 1596 - DNA, 17 bp; single-stranded, linear
aauuacuuagaggccau

SEQ ID NO: 1597 - DNA, 17 bp; single-stranded, linear
gaggccauacucuuguc

SEQ ID NO: 1598 - DNA, 17 bp; single-stranded, linear
gccauacucuuguccuc

SEQ ID NO: 1599 - DNA, 17 bp; single-stranded, linear
cauacucuuguccucaa

SEQ ID NO: 1600 - DNA, 17 bp; single-stranded, linear
acucuuguccucaauug

SEQ ID NO: 1601 - DNA, 17 bp; single-stranded, linear
cuuguccucaauuguac

SEQ ID NO: 1602 - DNA, 17 bp; single-stranded, linear
uccucaauuguacugcu

SEQ ID NO: 1603 - DNA, 17 bp; single-stranded, linear
ucaauuguacugcuacc

SEQ ID NO: 1604 - DNA, 17 bp; single-stranded, linear
guacugcuaccacuccc

SEQ ID NO: 1605 - DNA, 17 bp; single-stranded, linear
cuaccacucccuugaac

SEQ ID NO: 1606 - DNA, 17 bp; single-stranded, linear
cacucccuugaacacga

SEQ ID NO: 1607 - DNA, 17 bp; single-stranded, linear
acgagaguucaaaugac

SEQ ID NO: 1608 - DNA, 17 bp; single-stranded, linear
cgagaguucaaaugacc

SEQ ID NO: 1609 - DNA, 17 bp; single-stranded, linear
ccuggaguuacccugau

SEQ ID NO: 1610 - DNA, 17 bp; single-stranded, linear
cuggaguuacccugaug

SEQ ID NO: 1611 - DNA, 17 bp; single-stranded, linear
aaaaaaauaagagagcu

SEQ ID NO: 1612 - DNA, 17 bp; single-stranded, linear
agagagcuuccguaagg

SEQ ID NO: 1613 - DNA, 17 bp; single-stranded, linear
gagagcuuccguaaggc

SEQ ID NO: 1614 - DNA, 17 bp; single-stranded, linear
gcuuccguaaggcgacg

SEQ ID NO: 1615 - DNA, 17 bp; single-stranded, linear
cgacgaauugaccaaag

SEQ ID NO: 1616 - DNA, 17 bp; single-stranded, linear
aaagcaauucccaugcc

SEQ ID NO: 1617 - DNA, 17 bp; single-stranded, linear
aagcaauucccaugcca

SEQ ID NO: 1618 - DNA, 17 bp; single-stranded, linear
gccaacauauucuacag

SEQ ID NO: 1619 - DNA, 17 bp; single-stranded, linear
caacauauucuacagug

SEQ ID NO: 1620 - DNA, 17 bp; single-stranded, linear
aacauauucuacagugu

SEQ ID NO: 1621 - DNA, 17 bp; single-stranded, linear
cauauucuacaguguuc

SEQ ID NO: 1622 - DNA, 17 bp; single-stranded, linear
uacaguguucuuacuau

SEQ ID NO: 1623 - DNA, 17 bp; single-stranded, linear
acaguguucuuacuauu

SEQ ID NO: 1624 - DNA, 17 bp; single-stranded, linear
aguguucuuacuauuga

SEQ ID NO: 1625 - DNA, 17 bp; single-stranded, linear
guguucuuacuauugac

SEQ ID NO: 1626 - DNA, 17 bp; single-stranded, linear
uucuuacuauugacaaa

SEQ ID NO: 1627 - DNA, 17 bp; single-stranded, linear
cuuacuauugacaaaau

SEQ ID NO: 1628 - DNA, 17 bp; single-stranded, linear
aaaggacuuuauacuug

SEQ ID NO: 1629 - DNA, 17 bp; single-stranded, linear
aaggacuuuauacuugu

SEQ ID NO: 1630 - DNA, 17 bp; single-stranded, linear
aggacuuuauacuuguc

SEQ ID NO: 1631 - DNA, 17 bp; single-stranded, linear
gacuuuauacuugucgu

SEQ ID NO: 1632 - DNA, 17 bp; single-stranded, linear
uuuauacuugucgugua

SEQ ID NO: 1633 - DNA, 17 bp; single-stranded, linear
auacuugucguguaagg

SEQ ID NO: 1634 - DNA, 17 bp; single-stranded, linear
ugucguguaaggagugg

SEQ ID NO: 1635 - DNA, 17 bp; single-stranded, linear
uggaccaucauucaaau

SEQ ID NO: 1636 - DNA, 17 bp; single-stranded, linear
accaucauucaaaucug

SEQ ID NO: 1637 - DNA, 17 bp; single-stranded, linear
ccaucauucaaaucugu

SEQ ID NO: 1638 - DNA, 17 bp; single-stranded, linear
auucaaaucuguuaaca

SEQ ID NO: 1639 - DNA, 17 bp; single-stranded, linear
aaaucuguuaacaccuc

SEQ ID NO: 1640 - DNA, 17 bp; single-stranded, linear
aaucuguuaacaccuca

SEQ ID NO: 1641 - DNA, 17 bp; single-stranded, linear
uaacaccucagugcaua

SEQ ID NO: 1642 - DNA, 17 bp; single-stranded, linear
cagugcauauauaugau

SEQ ID NO: 1643 - DNA, 17 bp; single-stranded, linear
gugcauauauaugauaa

SEQ ID NO: 1644 - DNA, 17 bp; single-stranded, linear
gcauauauaugauaaag

SEQ ID NO: 1645 - DNA, 17 bp; single-stranded, linear
uauaugauaaagcauuc

SEQ ID NO: 1646 - DNA, 17 bp; single-stranded, linear
uaaagcauucaucacug

SEQ ID NO: 1647 - DNA, 17 bp; single-stranded, linear
aaagcauucaucacugu

SEQ ID NO: 1648 - DNA, 17 bp; single-stranded, linear
gcauucaucacugugaa

SEQ ID NO: 1649 - DNA, 17 bp; single-stranded, linear
ugaaacaucgaaaacag

SEQ ID NO: 1650 - DNA, 17 bp; single-stranded, linear
caggugcuugaaaccgu

SEQ ID NO: 1651 - DNA, 17 bp; single-stranded, linear
gaaaccguagcuggcaa

SEQ ID NO: 1652 - DNA, 17 bp; single-stranded, linear
caagcggucuuaccggc

SEQ ID NO: 1653 - DNA, 17 bp; single-stranded, linear
agcggucuuaccggcuc

SEQ ID NO: 1654 - DNA, 17 bp; single-stranded, linear
gcggucuuaccggcucu

SEQ ID NO: 1655 - DNA, 17 bp; single-stranded, linear
uaccggcucucuaugaa

SEQ ID NO: 1656 - DNA, 17 bp; single-stranded, linear
ccggcucucuaugaaag

SEQ ID NO: 1657 - DNA, 17 bp; single-stranded, linear
ggcucucuaugaaagug

SEQ ID NO: 1658 - DNA, 17 bp; single-stranded, linear
gaaggcauuucccucgc

SEQ ID NO: 1659 - DNA, 17 bp; single-stranded, linear
aaggcauuucccucgcc

SEQ ID NO: 1660 - DNA, 17 bp; single-stranded, linear
aggcauuucccucgccg

SEQ ID NO: 1661 - DNA, 17 bp; single-stranded, linear
auuucccucgccggaag

SEQ ID NO: 1662 - DNA, 17 bp; single-stranded, linear
ccggaaguuguaugguu

SEQ ID NO: 1663 - DNA, 17 bp; single-stranded, linear
gaaguuguaugguuaaa

SEQ ID NO: 1664 - DNA, 17 bp; single-stranded, linear
uguaugguuaaaagaug

SEQ ID NO: 1665 - DNA, 17 bp; single-stranded, linear
guaugguuaaaagaugg

SEQ ID NO: 1666 - DNA, 17 bp; single-stranded, linear
agauggguuaccugcga

SEQ ID NO: 1667 - DNA, 17 bp; single-stranded, linear
gauggguuaccugcgac

SEQ ID NO: 1668 - DNA, 17 bp; single-stranded, linear
ugagaaaucugcucgcu

SEQ ID NO: 1669 - DNA, 17 bp; single-stranded, linear
aaucugcucgcuauuug

SEQ ID NO: 1670 - DNA, 17 bp; single-stranded, linear
ugcucgcuauuugacuc

SEQ ID NO: 1671 - DNA, 17 bp; single-stranded, linear
cucgcuauuugacucgu

SEQ ID NO: 1672 - DNA, 17 bp; single-stranded, linear
ucgcuauuugacucgug

SEQ ID NO: 1673 - DNA, 17 bp; single-stranded, linear
auuugacucguggcuac

SEQ ID NO: 1674 - DNA, 17 bp; single-stranded, linear
ucguggcuacucguuaa

SEQ ID NO: 1675 - DNA, 17 bp; single-stranded, linear
uggcuacucguuaauua

SEQ ID NO: 1676 - DNA, 17 bp; single-stranded, linear
cuacucguuaauuauca

SEQ ID NO: 1677 - DNA, 17 bp; single-stranded, linear
uacucguuaauuaucaa

SEQ ID NO: 1678 - DNA, 17 bp; single-stranded, linear
ucguuaauuaucaagga

SEQ ID NO: 1679 - DNA, 17 bp; single-stranded, linear
cguuaauuaucaaggac

SEQ ID NO: 1680 - DNA, 17 bp; single-stranded, linear
uuaauuaucaaggacgu

SEQ ID NO: 1681 - DNA, 17 bp; single-stranded, linear
aaggacguaacugaaga

SEQ ID NO: 1682 - DNA, 17 bp; single-stranded, linear
cagggaauuauacaauc

SEQ ID NO: 1683 - DNA, 17 bp; single-stranded, linear
agggaauuauacaaucu

SEQ ID NO: 1684 - DNA, 17 bp; single-stranded, linear
ggaauuauacaaucuug

SEQ ID NO: 1685 - DNA, 17 bp; single-stranded, linear
uauacaaucuugcugag

SEQ ID NO: 1686 - DNA, 17 bp; single-stranded, linear
uacaaucuugcugagca

SEQ ID NO: 1687 - DNA, 17 bp; single-stranded, linear
cugagcauaaaacaguc

SEQ ID NO: 1688 - DNA, 17 bp; single-stranded, linear
aaaacagucaaaugugu

SEQ ID NO: 1689 - DNA, 17 bp; single-stranded, linear
aaauguguuuaaaaacc

SEQ ID NO: 1690 - DNA, 17 bp; single-stranded, linear
aauguguuuaaaaaccu

SEQ ID NO: 1691 - DNA, 17 bp; single-stranded, linear
auguguuuaaaaaccuc

SEQ ID NO: 1692 - DNA, 17 bp; single-stranded, linear
aaaaaccucacugccac

SEQ ID NO: 1693 - DNA, 17 bp; single-stranded, linear
cugccacucuaauuguc

SEQ ID NO: 1694 - DNA, 17 bp; single-stranded, linear
gccacucuaauugucaa

SEQ ID NO: 1695 - DNA, 17 bp; single-stranded, linear
acucuaauugucaaugu

SEQ ID NO: 1696 - DNA, 17 bp; single-stranded, linear
cuaauugucaaugugaa

SEQ ID NO: 1697 - DNA, 17 bp; single-stranded, linear
ccccagauuuacgaaaa

SEQ ID NO: 1698 - DNA, 17 bp; single-stranded, linear
cccagauuuacgaaaag

SEQ ID NO: 1699 - DNA, 17 bp; single-stranded, linear
ccagauuuacgaaaagg

SEQ ID NO: 1700 - DNA, 17 bp; single-stranded, linear
ggccgugucaucguuuc

SEQ ID NO: 1701 - DNA, 17 bp; single-stranded, linear
cgugucaucguuuccag

SEQ ID NO: 1702 - DNA, 17 bp; single-stranded, linear
gucaucguuuccagacc

SEQ ID NO: 1703 - DNA, 17 bp; single-stranded, linear
ucaucguuuccagaccc

SEQ ID NO: 1704 - DNA, 17 bp; single-stranded, linear
caucguuuccagacccg

SEQ ID NO: 1705 - DNA, 17 bp; single-stranded, linear
acccggcucucuaccca

SEQ ID NO: 1706 - DNA, 17 bp; single-stranded, linear
ccggcucucuacccacu

SEQ ID NO: 1707 - DNA, 17 bp; single-stranded, linear
ggcucucuacccacugg

SEQ ID NO: 1708 - DNA, 17 bp; single-stranded, linear
agacaaauccugacuug

SEQ ID NO: 1709 - DNA, 17 bp; single-stranded, linear
uccugacuuguaccgca

SEQ ID NO: 1710 - DNA, 17 bp; single-stranded, linear
ugacuuguaccgcauau

SEQ ID NO: 1711 - DNA, 17 bp; single-stranded, linear
uaccgcauaugguaucc

SEQ ID NO: 1712 - DNA, 17 bp; single-stranded, linear
cauaugguaucccucaa

SEQ ID NO: 1713 - DNA, 17 bp; single-stranded, linear
uaugguaucccucaacc

SEQ ID NO: 1714 - DNA, 17 bp; single-stranded, linear
guaucccucaaccuaca

SEQ ID NO: 1715 - DNA, 17 bp; single-stranded, linear
cucaaccuacaaucaag

SEQ ID NO: 1716 - DNA, 17 bp; single-stranded, linear
ccuacaaucaagugguu

SEQ ID NO: 1717 - DNA, 17 bp; single-stranded, linear
caagugguucuggcacc

SEQ ID NO: 1718 - DNA, 17 bp; single-stranded, linear
aagugguucuggcaccc

SEQ ID NO: 1719 - DNA, 17 bp; single-stranded, linear
accccuguaaccauaau

SEQ ID NO: 1720 - DNA, 17 bp; single-stranded, linear
guaaccauaaucauucc

SEQ ID NO: 1721 - DNA, 17 bp; single-stranded, linear
accauaaucauuccgaa

SEQ ID NO: 1722 - DNA, 17 bp; single-stranded, linear
auaaucauuccgaagca

SEQ ID NO: 1723 - DNA, 17 bp; single-stranded, linear
uaaucauuccgaagcaa

SEQ ID NO: 1724 - DNA, 17 bp; single-stranded, linear
gugugacuuuuguucca

SEQ ID NO: 1725 - DNA, 17 bp; single-stranded, linear
ugugacuuuuguuccaa

SEQ ID NO: 1726 - DNA, 17 bp; single-stranded, linear
gugacuuuuguuccaau

SEQ ID NO: 1727 - DNA, 17 bp; single-stranded, linear
acuuuuguuccaauaau

SEQ ID NO: 1728 - DNA, 17 bp; single-stranded, linear
cuuuuguuccaauaaug

SEQ ID NO: 1729 - DNA, 17 bp; single-stranded, linear
guuccaauaaugaagag

SEQ ID NO: 1730 - DNA, 17 bp; single-stranded, linear
ugaagaguccuuuaucc

SEQ ID NO: 1731 - DNA, 17 bp; single-stranded, linear
agaguccuuuauccugg

SEQ ID NO: 1732 - DNA, 17 bp; single-stranded, linear
gaguccuuuauccugga

SEQ ID NO: 1733 - DNA, 17 bp; single-stranded, linear
aguccuuuauccuggau

SEQ ID NO: 1734 - DNA, 17 bp; single-stranded, linear
uccuuuauccuggaugc

SEQ ID NO: 1735 - DNA, 17 bp; single-stranded, linear
aacagaauugagagcau

SEQ ID NO: 1736 - DNA, 17 bp; single-stranded, linear
gagagcaucacucagcg

SEQ ID NO: 1737 - DNA, 17 bp; single-stranded, linear
gcaucacucagcgcaug

SEQ ID NO: 1738 - DNA, 17 bp; single-stranded, linear
auggcaauaauagaagg

SEQ ID NO: 1739 - DNA, 17 bp; single-stranded, linear
gcaauaauagaaggaaa

SEQ ID NO: 1740 - DNA, 17 bp; single-stranded, linear
gaaagaauaagauggcu

SEQ ID NO: 1741 - DNA, 17 bp; single-stranded, linear
agauggcuagcaccuug

SEQ ID NO: 1742 - DNA, 17 bp; single-stranded, linear
uagcaccuugguugugg

SEQ ID NO: 1743 - DNA, 17 bp; single-stranded, linear
accuugguuguggcuga

SEQ ID NO: 1744 - DNA, 17 bp; single-stranded, linear
ggcugacucuagaauuu

SEQ ID NO: 1745 - DNA, 17 bp; single-stranded, linear
cugacucuagaauuucu

SEQ ID NO: 1746 - DNA, 17 bp; single-stranded, linear
ucuagaauuucuggaau

SEQ ID NO: 1747 - DNA, 17 bp; single-stranded, linear
cuagaauuucuggaauc

SEQ ID NO: 1748 - DNA, 17 bp; single-stranded, linear
uagaauuucuggaaucu

SEQ ID NO: 1749 - DNA, 17 bp; single-stranded, linear
ucuggaaucuacauuug

SEQ ID NO: 1750 - DNA, 17 bp; single-stranded, linear
uggaaucuacauuugca

SEQ ID NO: 1751 - DNA, 17 bp; single-stranded, linear
aucuacauuugcauagc

SEQ ID NO: 1752 - DNA, 17 bp; single-stranded, linear
ucuacauuugcauagcu

SEQ ID NO: 1753 - DNA, 17 bp; single-stranded, linear
auuugcauagcuuccaa

SEQ ID NO: 1754 - DNA, 17 bp; single-stranded, linear
gcauagcuuccaauaaa

SEQ ID NO: 1755 - DNA, 17 bp; single-stranded, linear
cauagcuuccaauaaag

SEQ ID NO: 1756 - DNA, 17 bp; single-stranded, linear
cuuccaauaaaguuggg

SEQ ID NO: 1757 - DNA, 17 bp; single-stranded, linear
aauaaaguugggacugu

SEQ ID NO: 1758 - DNA, 17 bp; single-stranded, linear
agaaacauaagcuuuua

SEQ ID NO: 1759 - DNA, 17 bp; single-stranded, linear
cauaagcuuuuauauca

SEQ ID NO: 1760 - DNA, 17 bp; single-stranded, linear
auaagcuuuuauaucac

SEQ ID NO: 1761 - DNA, 17 bp; single-stranded, linear
uaagcuuuuauaucaca

SEQ ID NO: 1762 - DNA, 17 bp; single-stranded, linear
aagcuuuuauaucacag

SEQ ID NO: 1763 - DNA, 17 bp; single-stranded, linear
gcuuuuauaucacagau

SEQ ID NO: 1764 - DNA, 17 bp; single-stranded, linear
uuuuauaucacagaugu

SEQ ID NO: 1765 - DNA, 17 bp; single-stranded, linear
aaauggguuucauguua

SEQ ID NO: 1766 - DNA, 17 bp; single-stranded, linear
aauggguuucauguuaa

SEQ ID NO: 1767 - DNA, 17 bp; single-stranded, linear
auggguuucauguuaac

SEQ ID NO: 1768 - DNA, 17 bp; single-stranded, linear
uuucauguuaacuugga

SEQ ID NO: 1769 - DNA, 17 bp; single-stranded, linear
uucauguuaacuuggaa

SEQ ID NO: 1770 - DNA, 17 bp; single-stranded, linear
uguuaacuuggaaaaaa

SEQ ID NO: 1771 - DNA, 17 bp; single-stranded, linear
gaaacugucuugcacag

SEQ ID NO: 1772 - DNA, 17 bp; single-stranded, linear
aacugucuugcacaguu

SEQ ID NO: 1773 - DNA, 17 bp; single-stranded, linear
ugcacaguuaacaaguu

SEQ ID NO: 1774 - DNA, 17 bp; single-stranded, linear
gcacaguuaacaaguuc

SEQ ID NO: 1775 - DNA, 17 bp; single-stranded, linear
uaacaaguucuuauaca

SEQ ID NO: 1776 - DNA, 17 bp; single-stranded, linear
aacaaguucuuauacag

SEQ ID NO: 1777 - DNA, 17 bp; single-stranded, linear
caaguucuuauacagag

SEQ ID NO: 1778 - DNA, 17 bp; single-stranded, linear
aaguucuuauacagaga

SEQ ID NO: 1779 - DNA, 17 bp; single-stranded, linear
guucuuauacagagacg

SEQ ID NO: 1780 - DNA, 17 bp; single-stranded, linear
agagacguuacuuggau

SEQ ID NO: 1781 - DNA, 17 bp; single-stranded, linear
gagacguuacuuggauu

SEQ ID NO: 1782 - DNA, 17 bp; single-stranded, linear
acguuacuuggauuuua

SEQ ID NO: 1783 - DNA, 17 bp; single-stranded, linear
acuuggauuuuacugcg

SEQ ID NO: 1784 - DNA, 17 bp; single-stranded, linear
cuuggauuuuacugcgg

SEQ ID NO: 1785 - DNA, 17 bp; single-stranded, linear
uuggauuuuacugcgga

SEQ ID NO: 1786 - DNA, 17 bp; single-stranded, linear
uggauuuuacugcggac

SEQ ID NO: 1787 - DNA, 17 bp; single-stranded, linear
cggacaguuaauaacag

SEQ ID NO: 1788 - DNA, 17 bp; single-stranded, linear
ggacaguuaauaacaga

SEQ ID NO: 1789 - DNA, 17 bp; single-stranded, linear
caguuaauaacagaaca

SEQ ID NO: 1790 - DNA, 17 bp; single-stranded, linear
aaugcacuacaguauua

SEQ ID NO: 1791 - DNA, 17 bp; single-stranded, linear
acuacaguauuagcaag

SEQ ID NO: 1792 - DNA, 17 bp; single-stranded, linear
uacaguauuagcaagca

SEQ ID NO: 1793 - DNA, 17 bp; single-stranded, linear
acaguauuagcaagcaa

SEQ ID NO: 1794 - DNA, 17 bp; single-stranded, linear
auggccaucacuaagga

SEQ ID NO: 1795 - DNA, 17 bp; single-stranded, linear
ccaucacuaaggagcac

SEQ ID NO: 1796 - DNA, 17 bp; single-stranded, linear
ggagcacuccaucacuc

SEQ ID NO: 1797 - DNA, 17 bp; single-stranded, linear
cacuccaucacucuuaa

SEQ ID NO: 1798 - DNA, 17 bp; single-stranded, linear
ccaucacucuuaaucuu

SEQ ID NO: 1799 - DNA, 17 bp; single-stranded, linear
aucacucuuaaucuuac

SEQ ID NO: 1800 - DNA, 17 bp; single-stranded, linear
ucacucuuaaucuuacc

SEQ ID NO: 1801 - DNA, 17 bp; single-stranded, linear
cucuuaaucuuaccauc

SEQ ID NO: 1802 - DNA, 17 bp; single-stranded, linear
cuuaaucuuaccaucau

SEQ ID NO: 1803 - DNA, 17 bp; single-stranded, linear
uuaaucuuaccaucaug

SEQ ID NO: 1804 - DNA, 17 bp; single-stranded, linear
cuuaccaucaugaaugu

SEQ ID NO: 1805 - DNA, 17 bp; single-stranded, linear
augaauguuucccugca

SEQ ID NO: 1806 - DNA, 17 bp; single-stranded, linear
ugaauguuucccugcaa

SEQ ID NO: 1807 - DNA, 17 bp; single-stranded, linear
gaauguuucccugcaag

SEQ ID NO: 1808 - DNA, 17 bp; single-stranded, linear
ugcaagauucaggcacc

SEQ ID NO: 1809 - DNA, 17 bp; single-stranded, linear
gcaagauucaggcaccu

SEQ ID NO: 1810 - DNA, 17 bp; single-stranded, linear
aggcaccuaugccugca

SEQ ID NO: 1811 - DNA, 17 bp; single-stranded, linear
aggaauguauacacagg

SEQ ID NO: 1812 - DNA, 17 bp; single-stranded, linear
gaauguauacacagggg

SEQ ID NO: 1813 - DNA, 17 bp; single-stranded, linear
gaagaaauccuccagaa

SEQ ID NO: 1814 - DNA, 17 bp; single-stranded, linear
gaaauccuccagaagaa

SEQ ID NO: 1815 - DNA, 17 bp; single-stranded, linear
aaagaaauuacaaucag

SEQ ID NO: 1816 - DNA, 17 bp; single-stranded, linear
aagaaauuacaaucaga

SEQ ID NO: 1817 - DNA, 17 bp; single-stranded, linear
auuacaaucagagauca

SEQ ID NO: 1818 - DNA, 17 bp; single-stranded, linear
ucagagaucaggaagca

SEQ ID NO: 1819 - DNA, 17 bp; single-stranded, linear
agcaccauaccuccugc

SEQ ID NO: 1820 - DNA, 17 bp; single-stranded, linear
ccauaccuccugcgaaa

SEQ ID NO: 1821 - DNA, 17 bp; single-stranded, linear
cgaaaccucagugauca

SEQ ID NO: 1822 - DNA, 17 bp; single-stranded, linear
ucagugaucacacagug

SEQ ID NO: 1823 - DNA, 17 bp; single-stranded, linear
guggccaucagcaguuc

SEQ ID NO: 1824 - DNA, 17 bp; single-stranded, linear
ucagcaguuccaccacu

SEQ ID NO: 1825 - DNA, 17 bp; single-stranded, linear
cagcaguuccaccacuu

SEQ ID NO: 1826 - DNA, 17 bp; single-stranded, linear
ccaccacuuuagacugu

SEQ ID NO: 1827 - DNA, 17 bp; single-stranded, linear
caccacuuuagacuguc

SEQ ID NO: 1828 - DNA, 17 bp; single-stranded, linear
accacuuuagacuguca

SEQ ID NO: 1829 - DNA, 17 bp; single-stranded, linear
uagacugucaugcuaau

SEQ ID NO: 1830 - DNA, 17 bp; single-stranded, linear
gucaugcuaaugguguc

SEQ ID NO: 1831 - DNA, 17 bp; single-stranded, linear
aaugguguccccgagcc

SEQ ID NO: 1832 - DNA, 17 bp; single-stranded, linear
ccgagccucagaucacu

SEQ ID NO: 1833 - DNA, 17 bp; single-stranded, linear
ccucagaucacuugguu

SEQ ID NO: 1834 - DNA, 17 bp; single-stranded, linear
agaucacuugguuuaaa

SEQ ID NO: 1835 - DNA, 17 bp; single-stranded, linear
cacuugguuuaaaaaca

SEQ ID NO: 1836 - DNA, 17 bp; single-stranded, linear
acuugguuuaaaaacaa

SEQ ID NO: 1837 - DNA, 17 bp; single-stranded, linear
cuugguuuaaaaacaac

SEQ ID NO: 1838 - DNA, 17 bp; single-stranded, linear
cacaaaauacaacaaga

SEQ ID NO: 1839 - DNA, 17 bp; single-stranded, linear
ccuggaauuauuuuagg

SEQ ID NO: 1840 - DNA, 17 bp; single-stranded, linear
cuggaauuauuuuagga

SEQ ID NO: 1841 - DNA, 17 bp; single-stranded, linear
ggaauuauuuuaggacc

SEQ ID NO: 1842 - DNA, 17 bp; single-stranded, linear
gaauuauuuuaggacca

SEQ ID NO: 1843 - DNA, 17 bp; single-stranded, linear
aauuauuuuaggaccag

SEQ ID NO: 1844 - DNA, 17 bp; single-stranded, linear
auuauuuuaggaccagg

SEQ ID NO: 1845 - DNA, 17 bp; single-stranded, linear
cacgcuguuuauugaaa

SEQ ID NO: 1846 - DNA, 17 bp; single-stranded, linear
acgcuguuuauugaaag

SEQ ID NO: 1847 - DNA, 17 bp; single-stranded, linear
cgcuguuuauugaaaga

SEQ ID NO: 1848 - DNA, 17 bp; single-stranded, linear
cuguuuauugaaagagu

SEQ ID NO: 1849 - DNA, 17 bp; single-stranded, linear
gaaagagucacagaaga

SEQ ID NO: 1850 - DNA, 17 bp; single-stranded, linear
gaaggugucuaucacug

SEQ ID NO: 1851 - DNA, 17 bp; single-stranded, linear
aggugucuaucacugca

SEQ ID NO: 1852 - DNA, 17 bp; single-stranded, linear
gugucuaucacugcaaa

SEQ ID NO: 1853 - DNA, 17 bp; single-stranded, linear
gaagggcucuguggaaa

SEQ ID NO: 1854 - DNA, 17 bp; single-stranded, linear
uggaaaguucagcauac

SEQ ID NO: 1855 - DNA, 17 bp; single-stranded, linear
ggaaaguucagcauacc

SEQ ID NO: 1856 - DNA, 17 bp; single-stranded, linear
uucagcauaccucacug

SEQ ID NO: 1857 - DNA, 17 bp; single-stranded, linear
gcauaccucacuguuca

SEQ ID NO: 1858 - DNA, 17 bp; single-stranded, linear
cucacuguucaaggaac

SEQ ID NO: 1859 - DNA, 17 bp; single-stranded, linear
ucacuguucaaggaacc

SEQ ID NO: 1860 - DNA, 17 bp; single-stranded, linear
aggaaccucggacaagu

SEQ ID NO: 1861 - DNA, 17 bp; single-stranded, linear
ggacaagucuaaucugg

SEQ ID NO: 1862 - DNA, 17 bp; single-stranded, linear
acaagucuaaucuggag

SEQ ID NO: 1863 - DNA, 17 bp; single-stranded, linear
agucuaaucuggagcug

SEQ ID NO: 1864 - DNA, 17 bp; single-stranded, linear
gagcugaucacucuaac

SEQ ID NO: 1865 - DNA, 17 bp; single-stranded, linear
ugaucacucuaacaugc

SEQ ID NO: 1866 - DNA, 17 bp; single-stranded, linear
aucacucuaacaugcac

SEQ ID NO: 1867 - DNA, 17 bp; single-stranded, linear
cugcgacucucuucugg

SEQ ID NO: 1868 - DNA, 17 bp; single-stranded, linear
gcgacucucuucuggcu

SEQ ID NO: 1869 - DNA, 17 bp; single-stranded, linear
gacucucuucuggcucc

SEQ ID NO: 1870 - DNA, 17 bp; single-stranded, linear
acucucuucuggcuccu

SEQ ID NO: 1871 - DNA, 17 bp; single-stranded, linear
uucuggcuccuauuaac

SEQ ID NO: 1872 - DNA, 17 bp; single-stranded, linear
uggcuccuauuaacccu

SEQ ID NO: 1873 - DNA, 17 bp; single-stranded, linear
gcuccuauuaacccucc

SEQ ID NO: 1874 - DNA, 17 bp; single-stranded, linear
cuccuauuaacccuccu

SEQ ID NO: 1875 - DNA, 17 bp; single-stranded, linear
uuaacccuccuuauccg

SEQ ID NO: 1876 - DNA, 17 bp; single-stranded, linear
acccuccuuauccgaaa

SEQ ID NO: 1877 - DNA, 17 bp; single-stranded, linear
cccuccuuauccgaaaa

SEQ ID NO: 1878 - DNA, 17 bp; single-stranded, linear
cuccuuauccgaaaaau

SEQ ID NO: 1879 - DNA, 17 bp; single-stranded, linear
gaaaaggucuucuucug

SEQ ID NO: 1880 - DNA, 17 bp; single-stranded, linear
aaaggucuucuucugaa

SEQ ID NO: 1881 - DNA, 17 bp; single-stranded, linear
aaggucuucuucugaaa

SEQ ID NO: 1882 - DNA, 17 bp; single-stranded, linear
ggucuucuucugaaaua

SEQ ID NO: 1883 - DNA, 17 bp; single-stranded, linear
gucuucuucugaaauaa

SEQ ID NO: 1884 - DNA, 17 bp; single-stranded, linear
ucugaaauaaagacuga

SEQ ID NO: 1885 - DNA, 17 bp; single-stranded, linear
gacugacuaccuaucaa

SEQ ID NO: 1886 - DNA, 17 bp; single-stranded, linear
gacuaccuaucaauuau

SEQ ID NO: 1887 - DNA, 17 bp; single-stranded, linear
cuaccuaucaauuauaa

SEQ ID NO: 1888 - DNA, 17 bp; single-stranded, linear
cuaucaauuauaaugga

SEQ ID NO: 1889 - DNA, 17 bp; single-stranded, linear
uaucaauuauaauggac

SEQ ID NO: 1890 - DNA, 17 bp; single-stranded, linear
ucaauuauaauggaccc

SEQ ID NO: 1891 - DNA, 17 bp; single-stranded, linear
gaugaaguuccuuugga

SEQ ID NO: 1892 - DNA, 17 bp; single-stranded, linear
augaaguuccuuuggau

SEQ ID NO: 1893 - DNA, 17 bp; single-stranded, linear
aaguuccuuuggaugag

SEQ ID NO: 1894 - DNA, 17 bp; single-stranded, linear
aguuccuuuggaugagc

SEQ ID NO: 1895 - DNA, 17 bp; single-stranded, linear
gagcggcucccuuauga

SEQ ID NO: 1896 - DNA, 17 bp; single-stranded, linear
ggcucccuuaugaugcc

SEQ ID NO: 1897 - DNA, 17 bp; single-stranded, linear
gcucccuuaugaugcca

SEQ ID NO: 1898 - DNA, 17 bp; single-stranded, linear
gugggaguuugcccggg

SEQ ID NO: 1899 - DNA, 17 bp; single-stranded, linear
ugggaguuugcccggga

SEQ ID NO: 1900 - DNA, 17 bp; single-stranded, linear
gagagacuuaaacuggg

SEQ ID NO: 1901 - DNA, 17 bp; single-stranded, linear
agagacuuaaacugggc

SEQ ID NO: 1902 - DNA, 17 bp; single-stranded, linear
gggcaaaucacuuggaa

SEQ ID NO: 1903 - DNA, 17 bp; single-stranded, linear
aaaucacuuggaagagg

SEQ ID NO: 1904 - DNA, 17 bp; single-stranded, linear
gaggggcuuuuggaaaa

SEQ ID NO: 1905 - DNA, 17 bp; single-stranded, linear
aggggcuuuuggaaaag

SEQ ID NO: 1906 - DNA, 17 bp; single-stranded, linear
ggggcuuuuggaaaagu

SEQ ID NO: 1907 - DNA, 17 bp; single-stranded, linear
aaagugguucaagcauc

SEQ ID NO: 1908 - DNA, 17 bp; single-stranded, linear
aagugguucaagcauca

SEQ ID NO: 1909 - DNA, 17 bp; single-stranded, linear
ucaagcaucagcauuug

SEQ ID NO: 1910 - DNA, 17 bp; single-stranded, linear
aucagcauuuggcauua

SEQ ID NO: 1911 - DNA, 17 bp; single-stranded, linear
ucagcauuuggcauuaa

SEQ ID NO: 1912 - DNA, 17 bp; single-stranded, linear
uuuggcauuaagaaauc

SEQ ID NO: 1913 - DNA, 17 bp; single-stranded, linear
uuggcauuaagaaauca

SEQ ID NO: 1914 - DNA, 17 bp; single-stranded, linear
uaagaaaucaccuacgu

SEQ ID NO: 1915 - DNA, 17 bp; single-stranded, linear
aaucaccuacgugccgg

SEQ ID NO: 1916 - DNA, 17 bp; single-stranded, linear
cagcgaguacaaagcuc

SEQ ID NO: 1917 - DNA, 17 bp; single-stranded, linear
acaaagcucugaugacu

SEQ ID NO: 1918 - DNA, 17 bp; single-stranded, linear
acugagcuaaaaaucuu

SEQ ID NO: 1919 - DNA, 17 bp; single-stranded, linear
cuaaaaaucuugaccca

SEQ ID NO: 1920 - DNA, 17 bp; single-stranded, linear
aaaaaucuugacccaca

SEQ ID NO: 1921 - DNA, 17 bp; single-stranded, linear
acccacauuggccacca

SEQ ID NO: 1922 - DNA, 17 bp; single-stranded, linear
gccaccaucugaacgug

SEQ ID NO: 1923 - DNA, 17 bp; single-stranded, linear
aacgugguuaaccugcu

SEQ ID NO: 1924 - DNA, 17 bp; single-stranded, linear
acgugguuaaccugcug

SEQ ID NO: 1925 - DNA, 17 bp; single-stranded, linear
gagggccucugauggug

SEQ ID NO: 1926 - DNA, 17 bp; single-stranded, linear
auggugauuguugaaua

SEQ ID NO: 1927 - DNA, 17 bp; single-stranded, linear
gugauuguugaauacug

SEQ ID NO: 1928 - DNA, 17 bp; single-stranded, linear
uguugaauacugcaaau

SEQ ID NO: 1929 - DNA, 17 bp; single-stranded, linear
cugcaaauauggaaauc

SEQ ID NO: 1930 - DNA, 17 bp; single-stranded, linear
auggaaaucucuccaac

SEQ ID NO: 1931 - DNA, 17 bp; single-stranded, linear
ggaaaucucuccaacua

SEQ ID NO: 1932 - DNA, 17 bp; single-stranded, linear
aaaucucuccaacuacc

SEQ ID NO: 1933 - DNA, 17 bp; single-stranded, linear
cuccaacuaccucaaga

SEQ ID NO: 1934 - DNA, 17 bp; single-stranded, linear
aacuaccucaagagcaa

SEQ ID NO: 1935 - DNA, 17 bp; single-stranded, linear
acgugacuuauuuuuuc

SEQ ID NO: 1936 - DNA, 17 bp; single-stranded, linear
cgugacuuauuuuuucu

SEQ ID NO: 1937 - DNA, 17 bp; single-stranded, linear
ugacuuauuuuuucuca

SEQ ID NO: 1938 - DNA, 17 bp; single-stranded, linear
gacuuauuuuuucucaa

SEQ ID NO: 1939 - DNA, 17 bp; single-stranded, linear
acuuauuuuuucucaac

SEQ ID NO: 1940 - DNA, 17 bp; single-stranded, linear
cuuauuuuuucucaaca

SEQ ID NO: 1941 - DNA, 17 bp; single-stranded, linear
uuauuuuuucucaacaa

SEQ ID NO: 1942 - DNA, 17 bp; single-stranded, linear
uauuuuuucucaacaag

SEQ ID NO: 1943 - DNA, 17 bp; single-stranded, linear
uuuuuucucaacaagga

SEQ ID NO: 1944 - DNA, 17 bp; single-stranded, linear
gcagcacuacacaugga

SEQ ID NO: 1945 - DNA, 17 bp; single-stranded, linear
uggagccuaagaaagaa

SEQ ID NO: 1946 - DNA, 17 bp; single-stranded, linear
ccaagacuagauagcgu

SEQ ID NO: 1947 - DNA, 17 bp; single-stranded, linear
gacuagauagcgucacc

SEQ ID NO: 1948 - DNA, 17 bp; single-stranded, linear
gauagcgucaccagcag

SEQ ID NO: 1949 - DNA, 17 bp; single-stranded, linear
cgaaagcuuugcgagcu

SEQ ID NO: 1950 - DNA, 17 bp; single-stranded, linear
gaaagcuuugcgagcuc

SEQ ID NO: 1951 - DNA, 17 bp; single-stranded, linear
ugcgagcuccggcuuuc

SEQ ID NO: 1952 - DNA, 17 bp; single-stranded, linear
cuccggcuuucaggaag

SEQ ID NO: 1953 - DNA, 17 bp; single-stranded, linear
uccggcuuucaggaaga

SEQ ID NO: 1954 - DNA, 17 bp; single-stranded, linear
ccggcuuucaggaagau

SEQ ID NO: 1955 - DNA, 17 bp; single-stranded, linear
aggaagauaaaagucug

SEQ ID NO: 1956 - DNA, 17 bp; single-stranded, linear
auaaaagucugagugau

SEQ ID NO: 1957 - DNA, 17 bp; single-stranded, linear
agugauguugaggaaga

SEQ ID NO: 1958 - DNA, 17 bp; single-stranded, linear
aggaggauucugacggu

SEQ ID NO: 1959 - DNA, 17 bp; single-stranded, linear
ggaggauucugacgguu

SEQ ID NO: 1960 - DNA, 17 bp; single-stranded, linear
cugacgguuucuacaag

SEQ ID NO: 1961 - DNA, 17 bp; single-stranded, linear
ugacgguuucuacaagg

SEQ ID NO: 1962 - DNA, 17 bp; single-stranded, linear
gacgguuucuacaagga

SEQ ID NO: 1963 - DNA, 17 bp; single-stranded, linear
cgguuucuacaaggagc

SEQ ID NO: 1964 - DNA, 17 bp; single-stranded, linear
gagcccaucacuaugga

SEQ ID NO: 1965 - DNA, 17 bp; single-stranded, linear
ccaucacuauggaagau

SEQ ID NO: 1966 - DNA, 17 bp; single-stranded, linear
uggaagaucugauuucu

SEQ ID NO: 1967 - DNA, 17 bp; single-stranded, linear
gaucugauuucuuacag

SEQ ID NO: 1968 - DNA, 17 bp; single-stranded, linear
aucugauuucuuacagu

SEQ ID NO: 1969 - DNA, 17 bp; single-stranded, linear
ucugauuucuuacaguu

SEQ ID NO: 1970 - DNA, 17 bp; single-stranded, linear
ugauuucuuacaguuuu

SEQ ID NO: 1971 - DNA, 17 bp; single-stranded, linear
gauuucuuacaguuuuc

SEQ ID NO: 1972 - DNA, 17 bp; single-stranded, linear
cuuacaguuuucaagug

SEQ ID NO: 1973 - DNA, 17 bp; single-stranded, linear
uuacaguuuucaagugg

SEQ ID NO: 1974 - DNA, 17 bp; single-stranded, linear
uacaguuuucaaguggc

SEQ ID NO: 1975 - DNA, 17 bp; single-stranded, linear
acaguuuucaaguggcc

SEQ ID NO: 1976 - DNA, 17 bp; single-stranded, linear
cauggaguuccugucuu

SEQ ID NO: 1977 - DNA, 17 bp; single-stranded, linear
auggaguuccugucuuc

SEQ ID NO: 1978 - DNA, 17 bp; single-stranded, linear
guuccugucuuccagaa

SEQ ID NO: 1979 - DNA, 17 bp; single-stranded, linear
uccugucuuccagaaag

SEQ ID NO: 1980 - DNA, 17 bp; single-stranded, linear
ccugucuuccagaaagu

SEQ ID NO: 1981 - DNA, 17 bp; single-stranded, linear
aagugcauucaucggga

SEQ ID NO: 1982 - DNA, 17 bp; single-stranded, linear
agugcauucaucgggac

SEQ ID NO: 1983 - DNA, 17 bp; single-stranded, linear
gcauucaucgggaccug

SEQ ID NO: 1984 - DNA, 17 bp; single-stranded, linear
agaaacauucuuuuauc

SEQ ID NO: 1985 - DNA, 17 bp; single-stranded, linear
gaaacauucuuuuaucu

SEQ ID NO: 1986 - DNA, 17 bp; single-stranded, linear
aacauucuuuuaucuga

SEQ ID NO: 1987 - DNA, 17 bp; single-stranded, linear
acauucuuuuaucugag

SEQ ID NO: 1988 - DNA, 17 bp; single-stranded, linear
cauucuuuuaucugaga

SEQ ID NO: 1989 - DNA, 17 bp; single-stranded, linear
auucuuuuaucugagaa

SEQ ID NO: 1990 - DNA, 17 bp; single-stranded, linear
ucuuuuaucugagaaca

SEQ ID NO: 1991 - DNA, 17 bp; single-stranded, linear
gugaagauuugugauuu

SEQ ID NO: 1992 - DNA, 17 bp; single-stranded, linear
ugaagauuugugauuuu

SEQ ID NO: 1993 - DNA, 17 bp; single-stranded, linear
uuugugauuuuggccuu

SEQ ID NO: 1994 - DNA, 17 bp; single-stranded, linear
uugugauuuuggccuug

SEQ ID NO: 1995 - DNA, 17 bp; single-stranded, linear
ugugauuuuggccuugc

SEQ ID NO: 1996 - DNA, 17 bp; single-stranded, linear
uuuggccuugcccggga

SEQ ID NO: 1997 - DNA, 17 bp; single-stranded, linear
cccgggauauuuauaag

SEQ ID NO: 1998 - DNA, 17 bp; single-stranded, linear
cgggauauuuauaagaa

SEQ ID NO: 1999 - DNA, 17 bp; single-stranded, linear
gggauauuuauaagaac

SEQ ID NO: 2000 - DNA, 17 bp; single-stranded, linear
ggauauuuauaagaacc

SEQ ID NO: 2001 - DNA, 17 bp; single-stranded, linear
auauuuauaagaacccc

SEQ ID NO: 2002 - DNA, 17 bp; single-stranded, linear
accccgauuaugugaga

SEQ ID NO: 2003 - DNA, 17 bp; single-stranded, linear
ccccgauuaugugagaa

SEQ ID NO: 2004 - DNA, 17 bp; single-stranded, linear
aaggagauacucgacuu

SEQ ID NO: 2005 - DNA, 17 bp; single-stranded, linear
gagauacucgacuuccu

SEQ ID NO: 2006 - DNA, 17 bp; single-stranded, linear
acucgacuuccucugaa

SEQ ID NO: 2007 - DNA, 17 bp; single-stranded, linear
cucgacuuccucugaaa

SEQ ID NO: 2008 - DNA, 17 bp; single-stranded, linear
gacuuccucugaaaugg

SEQ ID NO: 2009 - DNA, 17 bp; single-stranded, linear
ggauggcucccgaaucu

SEQ ID NO: 2010 - DNA, 17 bp; single-stranded, linear
ucccgaaucuaucuuug

SEQ ID NO: 2011 - DNA, 17 bp; single-stranded, linear
ccgaaucuaucuuugac

SEQ ID NO: 2012 - DNA, 17 bp; single-stranded, linear
gaaucuaucuuugacaa

SEQ ID NO: 2013 - DNA, 17 bp; single-stranded, linear
aucuaucuuugacaaaa

SEQ ID NO: 2014 - DNA, 17 bp; single-stranded, linear
ucuaucuuugacaaaau

SEQ ID NO: 2015 - DNA, 17 bp; single-stranded, linear
gacaaaaucuacagcac

SEQ ID NO: 2016 - DNA, 17 bp; single-stranded, linear
caaaaucuacagcacca

SEQ ID NO: 2017 - DNA, 17 bp; single-stranded, linear
cguguggucuuacggag

SEQ ID NO: 2018 - DNA, 17 bp; single-stranded, linear
uguggucuuacggagua

SEQ ID NO: 2019 - DNA, 17 bp; single-stranded, linear
guggucuuacggaguau

SEQ ID NO: 2020 - DNA, 17 bp; single-stranded, linear
uacggaguauugcugug

SEQ ID NO: 2021 - DNA, 17 bp; single-stranded, linear
cggaguauugcuguggg

SEQ ID NO: 2022 - DNA, 17 bp; single-stranded, linear
ugggaaaucuucuccuu

SEQ ID NO: 2023 - DNA, 17 bp; single-stranded, linear
ggaaaucuucuccuuag

SEQ ID NO: 2024 - DNA, 17 bp; single-stranded, linear
gaaaucuucuccuuagg

SEQ ID NO: 2025 - DNA, 17 bp; single-stranded, linear
aaucuucuccuuaggug

SEQ ID NO: 2026 - DNA, 17 bp; single-stranded, linear
cuucuccuuaggugggu

SEQ ID NO: 2027 - DNA, 17 bp; single-stranded, linear
uucuccuuagguggguc

SEQ ID NO: 2028 - DNA, 17 bp; single-stranded, linear
aggugggucuccauacc

SEQ ID NO: 2029 - DNA, 17 bp; single-stranded, linear
gugggucuccauaccca

SEQ ID NO: 2030 - DNA, 17 bp; single-stranded, linear
gucuccauacccaggag

SEQ ID NO: 2031 - DNA, 17 bp; single-stranded, linear
ccaggaguacaaaugga

SEQ ID NO: 2032 - DNA, 17 bp; single-stranded, linear
ugaggacuuuugcaguc

SEQ ID NO: 2033 - DNA, 17 bp; single-stranded, linear
gaggacuuuugcagucg

SEQ ID NO: 2034 - DNA, 17 bp; single-stranded, linear
aggacuuuugcagucgc

SEQ ID NO: 2035 - DNA, 17 bp; single-stranded, linear
uuugcagucgccugagg

SEQ ID NO: 2036 - DNA, 17 bp; single-stranded, linear
ugagagcuccugaguac

SEQ ID NO: 2037 - DNA, 17 bp; single-stranded, linear
uccugaguacucuacuc

SEQ ID NO: 2038 - DNA, 17 bp; single-stranded, linear
ugaguacucuacuccug

SEQ ID NO: 2039 - DNA, 17 bp; single-stranded, linear
aguacucuacuccugaa

SEQ ID NO: 2040 - DNA, 17 bp; single-stranded, linear
acucuacuccugaaauc

SEQ ID NO: 2041 - DNA, 17 bp; single-stranded, linear
ccugaaaucuaucagau

SEQ ID NO: 2042 - DNA, 17 bp; single-stranded, linear
ugaaaucuaucagauca

SEQ ID NO: 2043 - DNA, 17 bp; single-stranded, linear
aaaucuaucagaucaug

SEQ ID NO: 2044 - DNA, 17 bp; single-stranded, linear
uaucagaucaugcugga

SEQ ID NO: 2045 - DNA, 17 bp; single-stranded, linear
gccaagauuugcagaac

SEQ ID NO: 2046 - DNA, 17 bp; single-stranded, linear
ccaagauuugcagaacu

SEQ ID NO: 2047 - DNA, 17 bp; single-stranded, linear
gcagaacuuguggaaaa

SEQ ID NO: 2048 - DNA, 17 bp; single-stranded, linear
gaaaaacuaggugauuu

SEQ ID NO: 2049 - DNA, 17 bp; single-stranded, linear
uaggugauuugcuucaa

SEQ ID NO: 2050 - DNA, 17 bp; single-stranded, linear
aggugauuugcuucaag

SEQ ID NO: 2051 - DNA, 17 bp; single-stranded, linear
gauuugcuucaagcaaa

SEQ ID NO: 2052 - DNA, 17 bp; single-stranded, linear
auuugcuucaagcaaau

SEQ ID NO: 2053 - DNA, 17 bp; single-stranded, linear
gcaaauguacaacagga

SEQ ID NO: 2054 - DNA, 17 bp; single-stranded, linear
aggaugguaaagacuac

SEQ ID NO: 2055 - DNA, 17 bp; single-stranded, linear
uaaagacuacaucccaa

SEQ ID NO: 2056 - DNA, 17 bp; single-stranded, linear
gacuacaucccaaucaa

SEQ ID NO: 2057 - DNA, 17 bp; single-stranded, linear
aucccaaucaaugccau

SEQ ID NO: 2058 - DNA, 17 bp; single-stranded, linear
aaugccauacugacagg

SEQ ID NO: 2059 - DNA, 17 bp; single-stranded, linear
caggaaauaguggguuu

SEQ ID NO: 2060 - DNA, 17 bp; single-stranded, linear
uaguggguuuacauacu

SEQ ID NO: 2061 - DNA, 17 bp; single-stranded, linear
aguggguuuacauacuc

SEQ ID NO: 2062 - DNA, 17 bp; single-stranded, linear
guggguuuacauacuca

SEQ ID NO: 2063 - DNA, 17 bp; single-stranded, linear
guuuacauacucaacuc

SEQ ID NO: 2064 - DNA, 17 bp; single-stranded, linear
uacauacucaacuccug

SEQ ID NO: 2065 - DNA, 17 bp; single-stranded, linear
acucaacuccugccuuc

SEQ ID NO: 2066 - DNA, 17 bp; single-stranded, linear
uccugccuucucugagg

SEQ ID NO: 2067 - DNA, 17 bp; single-stranded, linear
ccugccuucucugagga

SEQ ID NO: 2068 - DNA, 17 bp; single-stranded, linear
ugccuucucugaggacu

SEQ ID NO: 2069 - DNA, 17 bp; single-stranded, linear
ugaggacuucuucaagg

SEQ ID NO: 2070 - DNA, 17 bp; single-stranded, linear
gaggacuucuucaagga

SEQ ID NO: 2071 - DNA, 17 bp; single-stranded, linear
ggacuucuucaaggaaa

SEQ ID NO: 2072 - DNA, 17 bp; single-stranded, linear
gacuucuucaaggaaag

SEQ ID NO: 2073 - DNA, 17 bp; single-stranded, linear
aggaaaguauuucagcu

SEQ ID NO: 2074 - DNA, 17 bp; single-stranded, linear
gaaaguauuucagcucc

SEQ ID NO: 2075 - DNA, 17 bp; single-stranded, linear
aaaguauuucagcuccg

SEQ ID NO: 2076 - DNA, 17 bp; single-stranded, linear
aaguauuucagcuccga

SEQ ID NO: 2077 - DNA, 17 bp; single-stranded, linear
uuucagcuccgaaguuu

SEQ ID NO: 2078 - DNA, 17 bp; single-stranded, linear
uccgaaguuuaauucag

SEQ ID NO: 2079 - DNA, 17 bp; single-stranded, linear
ccgaaguuuaauucagg

SEQ ID NO: 2080 - DNA, 17 bp; single-stranded, linear
cgaaguuuaauucagga

SEQ ID NO: 2081 - DNA, 17 bp; single-stranded, linear
aguuuaauucaggaagc

SEQ ID NO: 2082 - DNA, 17 bp; single-stranded, linear
guuuaauucaggaagcu

SEQ ID NO: 2083 - DNA, 17 bp; single-stranded, linear
aggaagcucugaugaug

SEQ ID NO: 2084 - DNA, 17 bp; single-stranded, linear
gaugaugucagauaugu

SEQ ID NO: 2085 - DNA, 17 bp; single-stranded, linear
ugucagauauguaaaug

SEQ ID NO: 2086 - DNA, 17 bp; single-stranded, linear
agauauguaaaugcuuu

SEQ ID NO: 2087 - DNA, 17 bp; single-stranded, linear
uaaaugcuuucaaguuc

SEQ ID NO: 2088 - DNA, 17 bp; single-stranded, linear
aaaugcuuucaaguuca

SEQ ID NO: 2089 - DNA, 17 bp; single-stranded, linear
aaugcuuucaaguucau

SEQ ID NO: 2090 - DNA, 17 bp; single-stranded, linear
uuucaaguucaugagcc

SEQ ID NO: 2091 - DNA, 17 bp; single-stranded, linear
uucaaguucaugagccu

SEQ ID NO: 2092 - DNA, 17 bp; single-stranded, linear
gaaagaaucaaaaccuu

SEQ ID NO: 2093 - DNA, 17 bp; single-stranded, linear
caaaaccuuugaagaac

SEQ ID NO: 2094 - DNA, 17 bp; single-stranded, linear
aaaaccuuugaagaacu

SEQ ID NO: 2095 - DNA, 17 bp; single-stranded, linear
gaagaacuuuuaccgaa

SEQ ID NO: 2096 - DNA, 17 bp; single-stranded, linear
aagaacuuuuaccgaau

SEQ ID NO: 2097 - DNA, 17 bp; single-stranded, linear
agaacuuuuaccgaaug

SEQ ID NO: 2098 - DNA, 17 bp; single-stranded, linear
gaacuuuuaccgaaugc

SEQ ID NO: 2099 - DNA, 17 bp; single-stranded, linear
ugccaccuccauguuug

SEQ ID NO: 2100 - DNA, 17 bp; single-stranded, linear
cuccauguuugaugacu

SEQ ID NO: 2101 - DNA, 17 bp; single-stranded, linear
uccauguuugaugacua

SEQ ID NO: 2102 - DNA, 17 bp; single-stranded, linear
ugaugacuaccagggcg

SEQ ID NO: 2103 - DNA, 17 bp; single-stranded, linear
gcagcacucuguuggcc

SEQ ID NO: 2104 - DNA, 17 bp; single-stranded, linear
cacucuguuggccucuc

SEQ ID NO: 2105 - DNA, 17 bp; single-stranded, linear
guuggccucucccaugc

SEQ ID NO: 2106 - DNA, 17 bp; single-stranded, linear
uggccucucccaugcug

SEQ ID NO: 2107 - DNA, 17 bp; single-stranded, linear
gaagcgcuucaccugga

SEQ ID NO: 2108 - DNA, 17 bp; single-stranded, linear
aagcgcuucaccuggac

SEQ ID NO: 2109 - DNA, 17 bp; single-stranded, linear
caaggccucgcucaaga

SEQ ID NO: 2110 - DNA, 17 bp; single-stranded, linear
gccucgcucaagauuga

SEQ ID NO: 2111 - DNA, 17 bp; single-stranded, linear
cucaagauugacuugag

SEQ ID NO: 2112 - DNA, 17 bp; single-stranded, linear
gauugacuugagaguaa

SEQ ID NO: 2113 - DNA, 17 bp; single-stranded, linear
uugagaguaaccaguaa

SEQ ID NO: 2114 - DNA, 17 bp; single-stranded, linear
uaaccaguaaaaguaag

SEQ ID NO: 2115 - DNA, 17 bp; single-stranded, linear
guaaaaguaaggagucg

SEQ ID NO: 2116 - DNA, 17 bp; single-stranded, linear
uaaggagucggggcugu

SEQ ID NO: 2117 - DNA, 17 bp; single-stranded, linear
ggggcugucugauguca

SEQ ID NO: 2118 - DNA, 17 bp; single-stranded, linear
ucugaugucagcaggcc

SEQ ID NO: 2119 - DNA, 17 bp; single-stranded, linear
ggcccaguuucugccau

SEQ ID NO: 2120 - DNA, 17 bp; single-stranded, linear
gcccaguuucugccauu

SEQ ID NO: 2121 - DNA, 17 bp; single-stranded, linear
cccaguuucugccauuc

SEQ ID NO: 2122 - DNA, 17 bp; single-stranded, linear
ucugccauuccagcugu

SEQ ID NO: 2123 - DNA, 17 bp; single-stranded, linear
cugccauuccagcugug

SEQ ID NO: 2124 - DNA, 17 bp; single-stranded, linear
gggcacgucagcgaagg

SEQ ID NO: 2125 - DNA, 17 bp; single-stranded, linear
gcgcagguucaccuacg

SEQ ID NO: 2126 - DNA, 17 bp; single-stranded, linear
cgcagguucaccuacga

SEQ ID NO: 2127 - DNA, 17 bp; single-stranded, linear
guucaccuacgaccacg

SEQ ID NO: 2128 - DNA, 17 bp; single-stranded, linear
aggaaaaucgcgugcug

SEQ ID NO: 2129 - DNA, 17 bp; single-stranded, linear
gugcugcuccccgcccc

SEQ ID NO: 2130 - DNA, 17 bp; single-stranded, linear
cccagacuacaacucgg

SEQ ID NO: 2131 - DNA, 17 bp; single-stranded, linear
cuacaacucgguggucc

SEQ ID NO: 2132 - DNA, 17 bp; single-stranded, linear
ucggugguccuguacuc

SEQ ID NO: 2133 - DNA, 17 bp; single-stranded, linear
gguccuguacuccaccc

SEQ ID NO: 2134 - DNA, 17 bp; single-stranded, linear
ccuguacuccaccccac

SEQ ID NO: 2135 - DNA, 17 bp; single-stranded, linear
ccacccaucuagaguuu

SEQ ID NO: 2136 - DNA, 17 bp; single-stranded, linear
acccaucuagaguuuga

SEQ ID NO: 2137 - DNA, 17 bp; single-stranded, linear
ucuagaguuugacacga

SEQ ID NO: 2138 - DNA, 17 bp; single-stranded, linear
cuagaguuugacacgaa

SEQ ID NO: 2139 - DNA, 17 bp; single-stranded, linear
cgaagccuuauuucuag

SEQ ID NO: 2140 - DNA, 17 bp; single-stranded, linear
gaagccuuauuucuaga

SEQ ID NO: 2141 - DNA, 17 bp; single-stranded, linear
agccuuauuucuagaag

SEQ ID NO: 2142 - DNA, 17 bp; single-stranded, linear
gccuuauuucuagaagc

SEQ ID NO: 2143 - DNA, 17 bp; single-stranded, linear
ccuuauuucuagaagca

SEQ ID NO: 2144 - DNA, 17 bp; single-stranded, linear
uuauuucuagaagcaca

SEQ ID NO: 2145 - DNA, 17 bp; single-stranded, linear
acauguguauuuauacc

SEQ ID NO: 2146 - DNA, 17 bp; single-stranded, linear
auguguauuuauacccc

SEQ ID NO: 2147 - DNA, 17 bp; single-stranded, linear
uguguauuuauaccccc

SEQ ID NO: 2148 - DNA, 17 bp; single-stranded, linear
guguauuuauaccccca

SEQ ID NO: 2149 - DNA, 17 bp; single-stranded, linear
guauuuauacccccagg

SEQ ID NO: 2150 - DNA, 17 bp; single-stranded, linear
aggaaacuagcuuuugc

SEQ ID NO: 2151 - DNA, 17 bp; single-stranded, linear
aacuagcuuuugccagu

SEQ ID NO: 2152 - DNA, 17 bp; single-stranded, linear
acuagcuuuugccagua

SEQ ID NO: 2153 - DNA, 17 bp; single-stranded, linear
cuagcuuuugccaguau

SEQ ID NO: 2154 - DNA, 17 bp; single-stranded, linear
uugccaguauuaugcau

SEQ ID NO: 2155 - DNA, 17 bp; single-stranded, linear
gccaguauuaugcauau

SEQ ID NO: 2156 - DNA, 17 bp; single-stranded, linear
ccaguauuaugcauaua

SEQ ID NO: 2157 - DNA, 17 bp; single-stranded, linear
uuaugcauauauaaguu

SEQ ID NO: 2158 - DNA, 17 bp; single-stranded, linear
augcauauauaaguuua

SEQ ID NO: 2159 - DNA, 17 bp; single-stranded, linear
gcauauauaaguuuaca

SEQ ID NO: 2160 - DNA, 17 bp; single-stranded, linear
auauaaguuuacaccuu

SEQ ID NO: 2161 - DNA, 17 bp; single-stranded, linear
uauaaguuuacaccuuu

SEQ ID NO: 2162 - DNA, 17 bp; single-stranded, linear
auaaguuuacaccuuua

SEQ ID NO: 2163 - DNA, 17 bp; single-stranded, linear
uuacaccuuuaucuuuc

SEQ ID NO: 2164 - DNA, 17 bp; single-stranded, linear
uacaccuuuaucuuucc

SEQ ID NO: 2165 - DNA, 17 bp; single-stranded, linear
acaccuuuaucuuucca

SEQ ID NO: 2166 - DNA, 17 bp; single-stranded, linear
accuuuaucuuuccaug

SEQ ID NO: 2167 - DNA, 17 bp; single-stranded, linear
cuuuaucuuuccauggg

SEQ ID NO: 2168 - DNA, 17 bp; single-stranded, linear
uuuaucuuuccauggga

SEQ ID NO: 2169 - DNA, 17 bp; single-stranded, linear
uuaucuuuccaugggag

SEQ ID NO: 2170 - DNA, 17 bp; single-stranded, linear
cagcugcuuuuugugau

SEQ ID NO: 2171 - DNA, 17 bp; single-stranded, linear
agcugcuuuuugugauu

SEQ ID NO: 2172 - DNA, 17 bp; single-stranded, linear
gcugcuuuuugugauuu

SEQ ID NO: 2173 - DNA, 17 bp; single-stranded, linear
cugcuuuuugugauuuu

SEQ ID NO: 2174 - DNA, 17 bp; single-stranded, linear
uuugugauuuuuuuaau

SEQ ID NO: 2175 - DNA, 17 bp; single-stranded, linear
uugugauuuuuuuaaua

SEQ ID NO: 2176 - DNA, 17 bp; single-stranded, linear
ugugauuuuuuuaauag

SEQ ID NO: 2177 - DNA, 17 bp; single-stranded, linear
gugauuuuuuuaauagu

SEQ ID NO: 2178 - DNA, 17 bp; single-stranded, linear
ugauuuuuuuaauagug

SEQ ID NO: 2179 - DNA, 17 bp; single-stranded, linear
gauuuuuuuaauagugc

SEQ ID NO: 2180 - DNA, 17 bp; single-stranded, linear
auuuuuuuaauagugcu

SEQ ID NO: 2181 - DNA, 17 bp; single-stranded, linear
uuuuuaauagugcuuuu

SEQ ID NO: 2182 - DNA, 17 bp; single-stranded, linear
auagugcuuuuuuuuuu

SEQ ID NO: 2183 - DNA, 17 bp; single-stranded, linear
uagugcuuuuuuuuuuu

SEQ ID NO: 2184 - DNA, 17 bp; single-stranded, linear
agugcuuuuuuuuuuug

SEQ ID NO: 2185 - DNA, 17 bp; single-stranded, linear
gugcuuuuuuuuuuuga

SEQ ID NO: 2186 - DNA, 17 bp; single-stranded, linear
ugcuuuuuuuuuuugac

SEQ ID NO: 2187 - DNA, 17 bp; single-stranded, linear
gcuuuuuuuuuuugacu

SEQ ID NO: 2188 - DNA, 17 bp; single-stranded, linear
cuuuuuuuuuuugacua

SEQ ID NO: 2189 - DNA, 17 bp; single-stranded, linear
uuuuuuuuuuugacuaa

SEQ ID NO: 2190 - DNA, 17 bp; single-stranded, linear
uuuuuuuuuugacuaac

SEQ ID NO: 2191 - DNA, 17 bp; single-stranded, linear
uuuuuuuuugacuaaca

SEQ ID NO: 2192 - DNA, 17 bp; single-stranded, linear
uuuugacuaacaagaau

SEQ ID NO: 2193 - DNA, 17 bp; single-stranded, linear
aagaauguaacuccaga

SEQ ID NO: 2194 - DNA, 17 bp; single-stranded, linear
auguaacuccagauaga

SEQ ID NO: 2195 - DNA, 17 bp; single-stranded, linear
cuccagauagagaaaua

SEQ ID NO: 2196 - DNA, 17 bp; single-stranded, linear
agagaaauagugacaag

SEQ ID NO: 2197 - DNA, 17 bp; single-stranded, linear
agaacacuacugcuaaa

SEQ ID NO: 2198 - DNA, 17 bp; single-stranded, linear
cuacugcuaaauccuca

SEQ ID NO: 2199 - DNA, 17 bp; single-stranded, linear
ugcuaaauccucauguu

SEQ ID NO: 2200 - DNA, 17 bp; single-stranded, linear
uaaauccucauguuacu

SEQ ID NO: 2201 - DNA, 17 bp; single-stranded, linear
ccucauguuacucagug

SEQ ID NO: 2202 - DNA, 17 bp; single-stranded, linear
cucauguuacucagugu

SEQ ID NO: 2203 - DNA, 17 bp; single-stranded, linear
auguuacucaguguuag

SEQ ID NO: 2204 - DNA, 17 bp; single-stranded, linear
cucaguguuagagaaau

SEQ ID NO: 2205 - DNA, 17 bp; single-stranded, linear
ucaguguuagagaaauc

SEQ ID NO: 2206 - DNA, 17 bp; single-stranded, linear
agagaaauccuuccuaa

SEQ ID NO: 2207 - DNA, 17 bp; single-stranded, linear
gaaauccuuccuaaacc

SEQ ID NO: 2208 - DNA, 17 bp; single-stranded, linear
aaauccuuccuaaaccc

SEQ ID NO: 2209 - DNA, 17 bp; single-stranded, linear
uccuuccuaaacccaau

SEQ ID NO: 2210 - DNA, 17 bp; single-stranded, linear
caaugacuucccugcuc

SEQ ID NO: 2211 - DNA, 17 bp; single-stranded, linear
aaugacuucccugcucc

SEQ ID NO: 2212 - DNA, 17 bp; single-stranded, linear
ucccugcuccaaccccc

SEQ ID NO: 2213 - DNA, 17 bp; single-stranded, linear
cgccaccucagggcacg

SEQ ID NO: 2214 - DNA, 17 bp; single-stranded, linear
ggaccaguuugauugag

SEQ ID NO: 2215 - DNA, 17 bp; single-stranded, linear
gaccaguuugauugagg

SEQ ID NO: 2216 - DNA, 17 bp; single-stranded, linear
aguuugauugaggagcu

SEQ ID NO: 2217 - DNA, 17 bp; single-stranded, linear
gcacugaucacccaaug

SEQ ID NO: 2218 - DNA, 17 bp; single-stranded, linear
caaugcaucacguaccc

SEQ ID NO: 2219 - DNA, 17 bp; single-stranded, linear
caucacguaccccacug

SEQ ID NO: 2220 - DNA, 17 bp; single-stranded, linear
aagcccguuagccccag

SEQ ID NO: 2221 - DNA, 17 bp; single-stranded, linear
agcccguuagccccagg

SEQ ID NO: 2222 - DNA, 17 bp; single-stranded, linear
caggggaucacuggcug

SEQ ID NO: 2223 - DNA, 17 bp; single-stranded, linear
agcaacaucucgggagu

SEQ ID NO: 2224 - DNA, 17 bp; single-stranded, linear
caacaucucgggagucc

SEQ ID NO: 2225 - DNA, 17 bp; single-stranded, linear
ucgggaguccucuagca

SEQ ID NO: 2226 - DNA, 17 bp; single-stranded, linear
ggaguccucuagcaggc

SEQ ID NO: 2227 - DNA, 17 bp; single-stranded, linear
aguccucuagcaggccu

SEQ ID NO: 2228 - DNA, 17 bp; single-stranded, linear
gcaggccuaagacaugu

SEQ ID NO: 2229 - DNA, 17 bp; single-stranded, linear
gaaagaauuugagacgc

SEQ ID NO: 2230 - DNA, 17 bp; single-stranded, linear
aaagaauuugagacgca

SEQ ID NO: 2231 - DNA, 17 bp; single-stranded, linear
acggggcucagcaaugc

SEQ ID NO: 2232 - DNA, 17 bp; single-stranded, linear
aaugccauuucaguggc

SEQ ID NO: 2233 - DNA, 17 bp; single-stranded, linear
augccauuucaguggcu

SEQ ID NO: 2234 - DNA, 17 bp; single-stranded, linear
ugccauuucaguggcuu

SEQ ID NO: 2235 - DNA, 17 bp; single-stranded, linear
caguggcuucccagcuc

SEQ ID NO: 2236 - DNA, 17 bp; single-stranded, linear
aguggcuucccagcucu

SEQ ID NO: 2237 - DNA, 17 bp; single-stranded, linear
ucccagcucugacccuu

SEQ ID NO: 2238 - DNA, 17 bp; single-stranded, linear
cugacccuucuacauuu

SEQ ID NO: 2239 - DNA, 17 bp; single-stranded, linear
ugacccuucuacauuug

SEQ ID NO: 2240 - DNA, 17 bp; single-stranded, linear
acccuucuacauuugag

SEQ ID NO: 2241 - DNA, 17 bp; single-stranded, linear
uucuacauuugagggcc

SEQ ID NO: 2242 - DNA, 17 bp; single-stranded, linear
ucuacauuugagggccc

SEQ ID NO: 2243 - DNA, 17 bp; single-stranded, linear
ggggacauuuucuggau

SEQ ID NO: 2244 - DNA, 17 bp; single-stranded, linear
gggacauuuucuggauu

SEQ ID NO: 2245 - DNA, 17 bp; single-stranded, linear
ggacauuuucuggauuc

SEQ ID NO: 2246 - DNA, 17 bp; single-stranded, linear
gacauuuucuggauucu

SEQ ID NO: 2247 - DNA, 17 bp; single-stranded, linear
uucuggauucugggagg

SEQ ID NO: 2248 - DNA, 17 bp; single-stranded, linear
ucuggauucugggaggc

SEQ ID NO: 2249 - DNA, 17 bp; single-stranded, linear
ggacaaauaucuuuuuu

SEQ ID NO: 2250 - DNA, 17 bp; single-stranded, linear
acaaauaucuuuuuugg

SEQ ID NO: 2251 - DNA, 17 bp; single-stranded, linear
aaauaucuuuuuuggaa

SEQ ID NO: 2252 - DNA, 17 bp; single-stranded, linear
aauaucuuuuuuggaac

SEQ ID NO: 2253 - DNA, 17 bp; single-stranded, linear
auaucuuuuuuggaacu

SEQ ID NO: 2254 - DNA, 17 bp; single-stranded, linear
uaucuuuuuuggaacua

SEQ ID NO: 2255 - DNA, 17 bp; single-stranded, linear
aucuuuuuuggaacuaa

SEQ ID NO: 2256 - DNA, 17 bp; single-stranded, linear
uuggaacuaaagcaaau

SEQ ID NO: 2257 - DNA, 17 bp; single-stranded, linear
aagcaaauuuuagaccu

SEQ ID NO: 2258 - DNA, 17 bp; single-stranded, linear
agcaaauuuuagaccuu

SEQ ID NO: 2259 - DNA, 17 bp; single-stranded, linear
gcaaauuuuagaccuuu

SEQ ID NO: 2260 - DNA, 17 bp; single-stranded, linear
caaauuuuagaccuuua

SEQ ID NO: 2261 - DNA, 17 bp; single-stranded, linear
uuagaccuuuaccuaug

SEQ ID NO: 2262 - DNA, 17 bp; single-stranded, linear
uagaccuuuaccuaugg

SEQ ID NO: 2263 - DNA, 17 bp; single-stranded, linear
agaccuuuaccuaugga

SEQ ID NO: 2264 - DNA, 17 bp; single-stranded, linear
cuuuaccuauggaagug

SEQ ID NO: 2265 - DNA, 17 bp; single-stranded, linear
gaagugguucuaugucc

SEQ ID NO: 2266 - DNA, 17 bp; single-stranded, linear
aagugguucuaugucca

SEQ ID NO: 2267 - DNA, 17 bp; single-stranded, linear
gugguucuauguccauu

SEQ ID NO: 2268 - DNA, 17 bp; single-stranded, linear
uucuauguccauucuca

SEQ ID NO: 2269 - DNA, 17 bp; single-stranded, linear
auguccauucucauucg

SEQ ID NO: 2270 - DNA, 17 bp; single-stranded, linear
uguccauucucauucgu

SEQ ID NO: 2271 - DNA, 17 bp; single-stranded, linear
uccauucucauucgugg

SEQ ID NO: 2272 - DNA, 17 bp; single-stranded, linear
auucucauucguggcau

SEQ ID NO: 2273 - DNA, 17 bp; single-stranded, linear
uucucauucguggcaug

SEQ ID NO: 2274 - DNA, 17 bp; single-stranded, linear
uggcauguuuugauuug

SEQ ID NO: 2275 - DNA, 17 bp; single-stranded, linear
ggcauguuuugauuugu

SEQ ID NO: 2276 - DNA, 17 bp; single-stranded, linear
gcauguuuugauuugua

SEQ ID NO: 2277 - DNA, 17 bp; single-stranded, linear
guuuugauuuguagcac

SEQ ID NO: 2278 - DNA, 17 bp; single-stranded, linear
uuuugauuuguagcacu

SEQ ID NO: 2279 - DNA, 17 bp; single-stranded, linear
ugauuuguagcacugag

SEQ ID NO: 2280 - DNA, 17 bp; single-stranded, linear
guggcacucaacucuga

SEQ ID NO: 2281 - DNA, 17 bp; single-stranded, linear
acucaacucugagccca

SEQ ID NO: 2282 - DNA, 17 bp; single-stranded, linear
gagcccauacuuuuggc

SEQ ID NO: 2283 - DNA, 17 bp; single-stranded, linear
cccauacuuuuggcucc

SEQ ID NO: 2284 - DNA, 17 bp; single-stranded, linear
ccauacuuuuggcuccu

SEQ ID NO: 2285 - DNA, 17 bp; single-stranded, linear
cauacuuuuggcuccuc

SEQ ID NO: 2286 - DNA, 17 bp; single-stranded, linear
uuuuggcuccucuagua

SEQ ID NO: 2287 - DNA, 17 bp; single-stranded, linear
uggcuccucuaguaaga

SEQ ID NO: 2288 - DNA, 17 bp; single-stranded, linear
gcuccucuaguaagaug

SEQ ID NO: 2289 - DNA, 17 bp; single-stranded, linear
ccucuaguaagaugcac

SEQ ID NO: 2290 - DNA, 17 bp; single-stranded, linear
ugaaaacuuagccagag

SEQ ID NO: 2291 - DNA, 17 bp; single-stranded, linear
gaaaacuuagccagagu

SEQ ID NO: 2292 - DNA, 17 bp; single-stranded, linear
gccagaguuagguuguc

SEQ ID NO: 2293 - DNA, 17 bp; single-stranded, linear
ccagaguuagguugucu

SEQ ID NO: 2294 - DNA, 17 bp; single-stranded, linear
aguuagguugucuccag

SEQ ID NO: 2295 - DNA, 17 bp; single-stranded, linear
uagguugucuccaggcc

SEQ ID NO: 2296 - DNA, 17 bp; single-stranded, linear
gguugucuccaggccau

SEQ ID NO: 2297 - DNA, 17 bp; single-stranded, linear
gauggccuuacacugaa

SEQ ID NO: 2298 - DNA, 17 bp; single-stranded, linear
auggccuuacacugaaa

SEQ ID NO: 2299 - DNA, 17 bp; single-stranded, linear
gaaaaugucacauucua

SEQ ID NO: 2300 - DNA, 17 bp; single-stranded, linear
ugucacauucuauuuug

SEQ ID NO: 2301 - DNA, 17 bp; single-stranded, linear
gucacauucuauuuugg

SEQ ID NO: 2302 - DNA, 17 bp; single-stranded, linear
cacauucuauuuugggu

SEQ ID NO: 2303 - DNA, 17 bp; single-stranded, linear
cauucuauuuuggguau

SEQ ID NO: 2304 - DNA, 17 bp; single-stranded, linear
auucuauuuuggguauu

SEQ ID NO: 2305 - DNA, 17 bp; single-stranded, linear
uucuauuuuggguauua

SEQ ID NO: 2306 - DNA, 17 bp; single-stranded, linear
uuuuggguauuaauaua

SEQ ID NO: 2307 - DNA, 17 bp; single-stranded, linear
uuggguauuaauauaua

SEQ ID NO: 2308 - DNA, 17 bp; single-stranded, linear
uggguauuaauauauag

SEQ ID NO: 2309 - DNA, 17 bp; single-stranded, linear
guauuaauauauagucc

SEQ ID NO: 2310 - DNA, 17 bp; single-stranded, linear
auuaauauauaguccag

SEQ ID NO: 2311 - DNA, 17 bp; single-stranded, linear
uaauauauaguccagac

SEQ ID NO: 2312 - DNA, 17 bp; single-stranded, linear
uauauaguccagacacu

SEQ ID NO: 2313 - DNA, 17 bp; single-stranded, linear
cagacacuuaacucaau

SEQ ID NO: 2314 - DNA, 17 bp; single-stranded, linear
agacacuuaacucaauu

SEQ ID NO: 2315 - DNA, 17 bp; single-stranded, linear
acuuaacucaauuucuu

SEQ ID NO: 2316 - DNA, 17 bp; single-stranded, linear
aacucaauuucuuggua

SEQ ID NO: 2317 - DNA, 17 bp; single-stranded, linear
acucaauuucuugguau

SEQ ID NO: 2318 - DNA, 17 bp; single-stranded, linear
cucaauuucuugguauu

SEQ ID NO: 2319 - DNA, 17 bp; single-stranded, linear
caauuucuugguauuau

SEQ ID NO: 2320 - DNA, 17 bp; single-stranded, linear
uucuugguauuauucug

SEQ ID NO: 2321 - DNA, 17 bp; single-stranded, linear
cuugguauuauucuguu

SEQ ID NO: 2322 - DNA, 17 bp; single-stranded, linear
uugguauuauucuguuu

SEQ ID NO: 2323 - DNA, 17 bp; single-stranded, linear
gguauuauucuguuuug

SEQ ID NO: 2324 - DNA, 17 bp; single-stranded, linear
guauuauucuguuuugc

SEQ ID NO: 2325 - DNA, 17 bp; single-stranded, linear
uauucuguuuugcacag

SEQ ID NO: 2326 - DNA, 17 bp; single-stranded, linear
auucuguuuugcacagu

SEQ ID NO: 2327 - DNA, 17 bp; single-stranded, linear
uucuguuuugcacaguu

SEQ ID NO: 2328 - DNA, 17 bp; single-stranded, linear
ugcacaguuaguuguga

SEQ ID NO: 2329 - DNA, 17 bp; single-stranded, linear
gcacaguuaguugugaa

SEQ ID NO: 2330 - DNA, 17 bp; single-stranded, linear
caguuaguugugaaaga

SEQ ID NO: 2331 - DNA, 17 bp; single-stranded, linear
aaugcaguccugaggag

SEQ ID NO: 2332 - DNA, 17 bp; single-stranded, linear
aggagaguuuucuccau

SEQ ID NO: 2333 - DNA, 17 bp; single-stranded, linear
ggagaguuuucuccaua

SEQ ID NO: 2334 - DNA, 17 bp; single-stranded, linear
gagaguuuucuccauau

SEQ ID NO: 2335 - DNA, 17 bp; single-stranded, linear
agaguuuucuccauauc

SEQ ID NO: 2336 - DNA, 17 bp; single-stranded, linear
aguuuucuccauaucaa

SEQ ID NO: 2337 - DNA, 17 bp; single-stranded, linear
uucuccauaucaaaacg

SEQ ID NO: 2338 - DNA, 17 bp; single-stranded, linear
cuccauaucaaaacgag

SEQ ID NO: 2339 - DNA, 17 bp; single-stranded, linear
aaaaaggucaauaaggu

SEQ ID NO: 2340 - DNA, 17 bp; single-stranded, linear
aggucaauaaggucaag

SEQ ID NO: 2341 - DNA, 17 bp; single-stranded, linear
aauaaggucaagggaag

SEQ ID NO: 2342 - DNA, 17 bp; single-stranded, linear
gaccccgucucuauacc

SEQ ID NO: 2343 - DNA, 17 bp; single-stranded, linear
ccccgucucuauaccaa

SEQ ID NO: 2344 - DNA, 17 bp; single-stranded, linear
ccgucucuauaccaacc

SEQ ID NO: 2345 - DNA, 17 bp; single-stranded, linear
gucucuauaccaaccaa

SEQ ID NO: 2346 - DNA, 17 bp; single-stranded, linear
aaaccaauucaccaaca

SEQ ID NO: 2347 - DNA, 17 bp; single-stranded, linear
aaccaauucaccaacac

SEQ ID NO: 2348 - DNA, 17 bp; single-stranded, linear
aacacaguugggaccca

SEQ ID NO: 2349 - DNA, 17 bp; single-stranded, linear
caggaagucagucacgu

SEQ ID NO: 2350 - DNA, 17 bp; single-stranded, linear
aagucagucacguuucc

SEQ ID NO: 2351 - DNA, 17 bp; single-stranded, linear
agucacguuuccuuuuc

SEQ ID NO: 2352 - DNA, 17 bp; single-stranded, linear
gucacguuuccuuuuca

SEQ ID NO: 2353 - DNA, 17 bp; single-stranded, linear
ucacguuuccuuuucau

SEQ ID NO: 2354 - DNA, 17 bp; single-stranded, linear
cguuuccuuuucauuua

SEQ ID NO: 2355 - DNA, 17 bp; single-stranded, linear
guuuccuuuucauuuaa

SEQ ID NO: 2356 - DNA, 17 bp; single-stranded, linear
uuuccuuuucauuuaau

SEQ ID NO: 2357 - DNA, 17 bp; single-stranded, linear
uuccuuuucauuuaaug

SEQ ID NO: 2358 - DNA, 17 bp; single-stranded, linear
cuuuucauuuaaugggg

SEQ ID NO: 2359 - DNA, 17 bp; single-stranded, linear
uuuucauuuaaugggga

SEQ ID NO: 2360 - DNA, 17 bp; single-stranded, linear
uuucauuuaauggggau

SEQ ID NO: 2361 - DNA, 17 bp; single-stranded, linear
auggggauuccacuauc

SEQ ID NO: 2362 - DNA, 17 bp; single-stranded, linear
uggggauuccacuaucu

SEQ ID NO: 2363 - DNA, 17 bp; single-stranded, linear
auuccacuaucucacac

SEQ ID NO: 2364 - DNA, 17 bp; single-stranded, linear
uccacuaucucacacua

SEQ ID NO: 2365 - DNA, 17 bp; single-stranded, linear
cacuaucucacacuaau

SEQ ID NO: 2366 - DNA, 17 bp; single-stranded, linear
cucacacuaaucugaaa

SEQ ID NO: 2367 - DNA, 17 bp; single-stranded, linear
acacuaaucugaaagga

SEQ ID NO: 2368 - DNA, 17 bp; single-stranded, linear
aagagcauuagcuggcg

SEQ ID NO: 2369 - DNA, 17 bp; single-stranded, linear
agagcauuagcuggcgc

SEQ ID NO: 2370 - DNA, 17 bp; single-stranded, linear
uggcgcauauuaagcac

SEQ ID NO: 2371 - DNA, 17 bp; single-stranded, linear
gcgcauauuaagcacuu

SEQ ID NO: 2372 - DNA, 17 bp; single-stranded, linear
cgcauauuaagcacuuu

SEQ ID NO: 2373 - DNA, 17 bp; single-stranded, linear
uaagcacuuuaagcucc

SEQ ID NO: 2374 - DNA, 17 bp; single-stranded, linear
aagcacuuuaagcuccu

SEQ ID NO: 2375 - DNA, 17 bp; single-stranded, linear
agcacuuuaagcuccuu

SEQ ID NO: 2376 - DNA, 17 bp; single-stranded, linear
uuuaagcuccuugagua

SEQ ID NO: 2377 - DNA, 17 bp; single-stranded, linear
aagcuccuugaguaaaa

SEQ ID NO: 2378 - DNA, 17 bp; single-stranded, linear
ccuugaguaaaaaggug

SEQ ID NO: 2379 - DNA, 17 bp; single-stranded, linear
aaggugguauguaauuu

SEQ ID NO: 2380 - DNA, 17 bp; single-stranded, linear
ugguauguaauuuaugc

SEQ ID NO: 2381 - DNA, 17 bp; single-stranded, linear
uauguaauuuaugcaag

SEQ ID NO: 2382 - DNA, 17 bp; single-stranded, linear
auguaauuuaugcaagg

SEQ ID NO: 2383 - DNA, 17 bp; single-stranded, linear
uguaauuuaugcaaggu

SEQ ID NO: 2384 - DNA, 17 bp; single-stranded, linear
ugcaagguauuucucca

SEQ ID NO: 2385 - DNA, 17 bp; single-stranded, linear
caagguauuucuccagu

SEQ ID NO: 2386 - DNA, 17 bp; single-stranded, linear
aagguauuucuccaguu

SEQ ID NO: 2387 - DNA, 17 bp; single-stranded, linear
agguauuucuccaguug

SEQ ID NO: 2388 - DNA, 17 bp; single-stranded, linear
guauuucuccaguuggg

SEQ ID NO: 2389 - DNA, 17 bp; single-stranded, linear
ucuccaguugggacuca

SEQ ID NO: 2390 - DNA, 17 bp; single-stranded, linear
uugggacucaggauauu

SEQ ID NO: 2391 - DNA, 17 bp; single-stranded, linear
cucaggauauuaguuaa

SEQ ID NO: 2392 - DNA, 17 bp; single-stranded, linear
caggauauuaguuaaug

SEQ ID NO: 2393 - DNA, 17 bp; single-stranded, linear
aggauauuaguuaauga

SEQ ID NO: 2394 - DNA, 17 bp; single-stranded, linear
auauuaguuaaugagcc

SEQ ID NO: 2395 - DNA, 17 bp; single-stranded, linear
uauuaguuaaugagcca

SEQ ID NO: 2396 - DNA, 17 bp; single-stranded, linear
ugagccaucacuagaag

SEQ ID NO: 2397 - DNA, 17 bp; single-stranded, linear
ccaucacuagaagaaaa

SEQ ID NO: 2398 - DNA, 17 bp; single-stranded, linear
aagcccauuuucaacug

SEQ ID NO: 2399 - DNA, 17 bp; single-stranded, linear
agcccauuuucaacugc

SEQ ID NO: 2400 - DNA, 17 bp; single-stranded, linear
gcccauuuucaacugcu

SEQ ID NO: 2401 - DNA, 17 bp; single-stranded, linear
cccauuuucaacugcuu

SEQ ID NO: 2402 - DNA, 17 bp; single-stranded, linear
caacugcuuugaaacuu

SEQ ID NO: 2403 - DNA, 17 bp; single-stranded, linear
aacugcuuugaaacuug

SEQ ID NO: 2404 - DNA, 17 bp; single-stranded, linear
uugaaacuugccugggg

SEQ ID NO: 2405 - DNA, 17 bp; single-stranded, linear
ccuggggucugagcaug

SEQ ID NO: 2406 - DNA, 17 bp; single-stranded, linear
augggaauagggagaca

SEQ ID NO: 2407 - DNA, 17 bp; single-stranded, linear
gacaggguaggaaaggg

SEQ ID NO: 2408 - DNA, 17 bp; single-stranded, linear
gggcgccuacucuucag

SEQ ID NO: 2409 - DNA, 17 bp; single-stranded, linear
cgccuacucuucagggu

SEQ ID NO: 2410 - DNA, 17 bp; single-stranded, linear
ccuacucuucagggucu

SEQ ID NO: 2411 - DNA, 17 bp; single-stranded, linear
cuacucuucagggucua

SEQ ID NO: 2412 - DNA, 17 bp; single-stranded, linear
uucagggucuaaagauc

SEQ ID NO: 2413 - DNA, 17 bp; single-stranded, linear
cagggucuaaagaucaa

SEQ ID NO: 2414 - DNA, 17 bp; single-stranded, linear
cuaaagaucaagugggc

SEQ ID NO: 2415 - DNA, 17 bp; single-stranded, linear
gugggccuuggaucgcu

SEQ ID NO: 2416 - DNA, 17 bp; single-stranded, linear
ccuuggaucgcuaagcu

SEQ ID NO: 2417 - DNA, 17 bp; single-stranded, linear
ggaucgcuaagcuggcu

SEQ ID NO: 2418 - DNA, 17 bp; single-stranded, linear
agcuggcucuguuugau

SEQ ID NO: 2419 - DNA, 17 bp; single-stranded, linear
ggcucuguuugaugcua

SEQ ID NO: 2420 - DNA, 17 bp; single-stranded, linear
gcucuguuugaugcuau

SEQ ID NO: 2421 - DNA, 17 bp; single-stranded, linear
uugaugcuauuuaugca

SEQ ID NO: 2422 - DNA, 17 bp; single-stranded, linear
gaugcuauuuaugcaag

SEQ ID NO: 2423 - DNA, 17 bp; single-stranded, linear
augcuauuuaugcaagu

SEQ ID NO: 2424 - DNA, 17 bp; single-stranded, linear
ugcuauuuaugcaaguu

SEQ ID NO: 2425 - DNA, 17 bp; single-stranded, linear
augcaaguuagggucua

SEQ ID NO: 2426 - DNA, 17 bp; single-stranded, linear
ugcaaguuagggucuau

SEQ ID NO: 2427 - DNA, 17 bp; single-stranded, linear
guuagggucuauguauu

SEQ ID NO: 2428 - DNA, 17 bp; single-stranded, linear
uagggucuauguauuua

SEQ ID NO: 2429 - DNA, 17 bp; single-stranded, linear
gucuauguauuuaggau

SEQ ID NO: 2430 - DNA, 17 bp; single-stranded, linear
cuauguauuuaggaugc

SEQ ID NO: 2431 - DNA, 17 bp; single-stranded, linear
uauguauuuaggaugcg

SEQ ID NO: 2432 - DNA, 17 bp; single-stranded, linear
auguauuuaggaugcgc

SEQ ID NO: 2433 - DNA, 17 bp; single-stranded, linear
augcgccuacucuucag

SEQ ID NO: 2434 - DNA, 17 bp; single-stranded, linear
cgccuacucuucagggu

SEQ ID NO: 2435 - DNA, 17 bp; single-stranded, linear
ccuacucuucagggucu

SEQ ID NO: 2436 - DNA, 17 bp; single-stranded, linear
cuacucuucagggucua

SEQ ID NO: 2437 - DNA, 17 bp; single-stranded, linear
uucagggucuaaagauc

SEQ ID NO: 2438 - DNA, 17 bp; single-stranded, linear
cagggucuaaagaucaa

SEQ ID NO: 2439 - DNA, 17 bp; single-stranded, linear
cuaaagaucaagugggc

SEQ ID NO: 2440 - DNA, 17 bp; single-stranded, linear
gugggccuuggaucgcu

SEQ ID NO: 2441 - DNA, 17 bp; single-stranded, linear
ccuuggaucgcuaagcu

SEQ ID NO: 2442 - DNA, 17 bp; single-stranded, linear
ggaucgcuaagcuggcu

SEQ ID NO: 2443 - DNA, 17 bp; single-stranded, linear
agcuggcucuguuugau

SEQ ID NO: 2444 - DNA, 17 bp; single-stranded, linear
ggcucuguuugaugcua

SEQ ID NO: 2445 - DNA, 17 bp; single-stranded, linear
gcucuguuugaugcuau

SEQ ID NO: 2446 - DNA, 17 bp; single-stranded, linear
uugaugcuauuuaugca

SEQ ID NO: 2447 - DNA, 17 bp; single-stranded, linear
gaugcuauuuaugcaag

SEQ ID NO: 2448 - DNA, 17 bp; single-stranded, linear
augcuauuuaugcaagu

SEQ ID NO: 2449 - DNA, 17 bp; single-stranded, linear
ugcuauuuaugcaaguu

SEQ ID NO: 2450 - DNA, 17 bp; single-stranded, linear
augcaaguuagggucua

SEQ ID NO: 2451 - DNA, 17 bp; single-stranded, linear
ugcaaguuagggucuau

SEQ ID NO: 2452 - DNA, 17 bp; single-stranded, linear
guuagggucuauguauu

SEQ ID NO: 2453 - DNA, 17 bp; single-stranded, linear
uagggucuauguauuua

SEQ ID NO: 2454 - DNA, 17 bp; single-stranded, linear
gucuauguauuuaggau

SEQ ID NO: 2455 - DNA, 17 bp; single-stranded, linear
cuauguauuuaggaugu

SEQ ID NO: 2456 - DNA, 17 bp; single-stranded, linear
uauguauuuaggauguc

SEQ ID NO: 2457 - DNA, 17 bp; single-stranded, linear
auguauuuaggaugucu

SEQ ID NO: 2458 - DNA, 17 bp; single-stranded, linear
uaggaugucugcaccuu

SEQ ID NO: 2459 - DNA, 17 bp; single-stranded, linear
cugcaccuucugcagcc

SEQ ID NO: 2460 - DNA, 17 bp; single-stranded, linear
ugcaccuucugcagcca

SEQ ID NO: 2461 - DNA, 17 bp; single-stranded, linear
cagccagucagaagcug

SEQ ID NO: 2462 - DNA, 17 bp; single-stranded, linear
caguggauugcugcuuc

SEQ ID NO: 2463 - DNA, 17 bp; single-stranded, linear
uugcugcuucuugggga

SEQ ID NO: 2464 - DNA, 17 bp; single-stranded, linear
ugcugcuucuuggggag

SEQ ID NO: 2465 - DNA, 17 bp; single-stranded, linear
cugcuucuuggggagaa

SEQ ID NO: 2466 - DNA, 17 bp; single-stranded, linear
agaagaguaugcuuccu

SEQ ID NO: 2467 - DNA, 17 bp; single-stranded, linear
aguaugcuuccuuuuau

SEQ ID NO: 2468 - DNA, 17 bp; single-stranded, linear
guaugcuuccuuuuauc

SEQ ID NO: 2469 - DNA, 17 bp; single-stranded, linear
ugcuuccuuuuauccau

SEQ ID NO: 2470 - DNA, 17 bp; single-stranded, linear
gcuuccuuuuauccaug

SEQ ID NO: 2471 - DNA, 17 bp; single-stranded, linear
cuuccuuuuauccaugu

SEQ ID NO: 2472 - DNA, 17 bp; single-stranded, linear
uuccuuuuauccaugua

SEQ ID NO: 2473 - DNA, 17 bp; single-stranded, linear
ccuuuuauccauguaau

SEQ ID NO: 2474 - DNA, 17 bp; single-stranded, linear
auccauguaauuuaacu

SEQ ID NO: 2475 - DNA, 17 bp; single-stranded, linear
cauguaauuuaacugua

SEQ ID NO: 2476 - DNA, 17 bp; single-stranded, linear
auguaauuuaacuguag

SEQ ID NO: 2477 - DNA, 17 bp; single-stranded, linear
uguaauuuaacuguaga

SEQ ID NO: 2478 - DNA, 17 bp; single-stranded, linear
uuaacuguagaaccuga

SEQ ID NO: 2479 - DNA, 17 bp; single-stranded, linear
ccugagcucuaaguaac

SEQ ID NO: 2480 - DNA, 17 bp; single-stranded, linear
ugagcucuaaguaaccg

SEQ ID NO: 2481 - DNA, 17 bp; single-stranded, linear
cucuaaguaaccgaaga

SEQ ID NO: 2482 - DNA, 17 bp; single-stranded, linear
aagaauguaugccucug

SEQ ID NO: 2483 - DNA, 17 bp; single-stranded, linear
guaugccucuguucuua

SEQ ID NO: 2484 - DNA, 17 bp; single-stranded, linear
gccucuguucuuaugug

SEQ ID NO: 2485 - DNA, 17 bp; single-stranded, linear
ccucuguucuuaugugc

SEQ ID NO: 2486 - DNA, 17 bp; single-stranded, linear
ucuguucuuaugugcca

SEQ ID NO: 2487 - DNA, 17 bp; single-stranded, linear
cuguucuuaugugccac

SEQ ID NO: 2488 - DNA, 17 bp; single-stranded, linear
ugccacauccuuguuua

SEQ ID NO: 2489 - DNA, 17 bp; single-stranded, linear
cacauccuuguuuaaag

SEQ ID NO: 2490 - DNA, 17 bp; single-stranded, linear
auccuuguuuaaaggcu

SEQ ID NO: 2491 - DNA, 17 bp; single-stranded, linear
uccuuguuuaaaggcuc

SEQ ID NO: 2492 - DNA, 17 bp; single-stranded, linear
ccuuguuuaaaggcucu

SEQ ID NO: 2493 - DNA, 17 bp; single-stranded, linear
uaaaggcucucuguaug

SEQ ID NO: 2494 - DNA, 17 bp; single-stranded, linear
aaggcucucuguaugaa

SEQ ID NO: 2495 - DNA, 17 bp; single-stranded, linear
cucucuguaugaagaga

SEQ ID NO: 2496 - DNA, 17 bp; single-stranded, linear
gggaccgucaucagcac

SEQ ID NO: 2497 - DNA, 17 bp; single-stranded, linear
accgucaucagcacauu

SEQ ID NO: 2498 - DNA, 17 bp; single-stranded, linear
cagcacauucccuagug

SEQ ID NO: 2499 - DNA, 17 bp; single-stranded, linear
agcacauucccuaguga

SEQ ID NO: 2500 - DNA, 17 bp; single-stranded, linear
cauucccuagugagccu

SEQ ID NO: 2501 - DNA, 17 bp; single-stranded, linear
gugagccuacuggcucc

SEQ ID NO: 2502 - DNA, 17 bp; single-stranded, linear
uacuggcuccuggcagc

SEQ ID NO: 2503 - DNA, 17 bp; single-stranded, linear
cagcggcuuuuguggaa

SEQ ID NO: 2504 - DNA, 17 bp; single-stranded, linear
agcggcuuuuguggaag

SEQ ID NO: 2505 - DNA, 17 bp; single-stranded, linear
gcggcuuuuguggaaga

SEQ ID NO: 2506 - DNA, 17 bp; single-stranded, linear
ggaagacucacuagcca

SEQ ID NO: 2507 - DNA, 17 bp; single-stranded, linear
gacucacuagccagaag

SEQ ID NO: 2508 - DNA, 17 bp; single-stranded, linear
gggacaguccucuccac

SEQ ID NO: 2509 - DNA, 17 bp; single-stranded, linear
acaguccucuccaccaa

SEQ ID NO: 2510 - DNA, 17 bp; single-stranded, linear
aguccucuccaccaaga

SEQ ID NO: 2511 - DNA, 17 bp; single-stranded, linear
accaagaucuaaaucca

SEQ ID NO: 2512 - DNA, 17 bp; single-stranded, linear
caagaucuaaauccaaa

SEQ ID NO: 2513 - DNA, 17 bp; single-stranded, linear
aucuaaauccaaacaaa

SEQ ID NO: 2514 - DNA, 17 bp; single-stranded, linear
agcaggcuagagccaga

SEQ ID NO: 2515 - DNA, 17 bp; single-stranded, linear
ggacaaaucuuuguugu

SEQ ID NO: 2516 - DNA, 17 bp; single-stranded, linear
acaaaucuuuguuguuc

SEQ ID NO: 2517 - DNA, 17 bp; single-stranded, linear
caaaucuuuguuguucc

SEQ ID NO: 2518 - DNA, 17 bp; single-stranded, linear
aucuuuguuguuccucu

SEQ ID NO: 2519 - DNA, 17 bp; single-stranded, linear
uuuguuguuccucuucu

SEQ ID NO: 2520 - DNA, 17 bp; single-stranded, linear
uuguuguuccucuucuu

SEQ ID NO: 2521 - DNA, 17 bp; single-stranded, linear
uuguuccucuucuuuac

SEQ ID NO: 2522 - DNA, 17 bp; single-stranded, linear
guuccucuucuuuacac

SEQ ID NO: 2523 - DNA, 17 bp; single-stranded, linear
uuccucuucuuuacaca

SEQ ID NO: 2524 - DNA, 17 bp; single-stranded, linear
ccucuucuuuacacaua

SEQ ID NO: 2525 - DNA, 17 bp; single-stranded, linear
cucuucuuuacacauac

SEQ ID NO: 2526 - DNA, 17 bp; single-stranded, linear
ucuucuuuacacauacg

SEQ ID NO: 2527 - DNA, 17 bp; single-stranded, linear
uuacacauacgcaaacc

SEQ ID NO: 2528 - DNA, 17 bp; single-stranded, linear
cuggcaauuuuauaaau

SEQ ID NO: 2529 - DNA, 17 bp; single-stranded, linear
uggcaauuuuauaaauc

SEQ ID NO: 2530 - DNA, 17 bp; single-stranded, linear
ggcaauuuuauaaauca

SEQ ID NO: 2531 - DNA, 17 bp; single-stranded, linear
gcaauuuuauaaaucag

SEQ ID NO: 2532 - DNA, 17 bp; single-stranded, linear
aauuuuauaaaucaggu

SEQ ID NO: 2533 - DNA, 17 bp; single-stranded, linear
uuauaaaucagguaacu

SEQ ID NO: 2534 - DNA, 17 bp; single-stranded, linear
aaucagguaacuggaag

SEQ ID NO: 2535 - DNA, 17 bp; single-stranded, linear
aaggagguuaaacucag

SEQ ID NO: 2536 - DNA, 17 bp; single-stranded, linear
aggagguuaaacucaga

SEQ ID NO: 2537 - DNA, 17 bp; single-stranded, linear
guuaaacucagaaaaaa

SEQ ID NO: 2538 - DNA, 17 bp; single-stranded, linear
gaagaccucagucaauu

SEQ ID NO: 2539 - DNA, 17 bp; single-stranded, linear
accucagucaauucucu

SEQ ID NO: 2540 - DNA, 17 bp; single-stranded, linear
cagucaauucucuacuu

SEQ ID NO: 2541 - DNA, 17 bp; single-stranded, linear
agucaauucucuacuuu

SEQ ID NO: 2542 - DNA, 17 bp; single-stranded, linear
ucaauucucuacuuuuu

SEQ ID NO: 2543 - DNA, 17 bp; single-stranded, linear
aauucucuacuuuuuuu

SEQ ID NO: 2544 - DNA, 17 bp; single-stranded, linear
ucucuacuuuuuuuuuu

SEQ ID NO: 2545 - DNA, 17 bp; single-stranded, linear
cucuacuuuuuuuuuuu

SEQ ID NO: 2546 - DNA, 17 bp; single-stranded, linear
ucuacuuuuuuuuuuuu

SEQ ID NO: 2547 - DNA, 17 bp; single-stranded, linear
cuacuuuuuuuuuuuuu

SEQ ID NO: 2548 - DNA, 17 bp; single-stranded, linear
uacuuuuuuuuuuuuuu

SEQ ID NO: 2549 - DNA, 17 bp; single-stranded, linear
acuuuuuuuuuuuuuuu

SEQ ID NO: 2550 - DNA, 17 bp; single-stranded, linear
cuuuuuuuuuuuuuuuu

SEQ ID NO: 2551 - DNA, 17 bp; single-stranded, linear
uuuuuuuuuuuuuuuuc

SEQ ID NO: 2552 - DNA, 17 bp; single-stranded, linear
uuuuuuuuuuuuuuucc

SEQ ID NO: 2553 - DNA, 17 bp; single-stranded, linear
uuuuuuuuuuuuuucca

SEQ ID NO: 2554 - DNA, 17 bp; single-stranded, linear
uuuuuuuuuuuuuccaa

SEQ ID NO: 2555 - DNA, 17 bp; single-stranded, linear
uuuuuuuuuuuuccaaa

SEQ ID NO: 2556 - DNA, 17 bp; single-stranded, linear
uuuuuuuuuuuccaaau

SEQ ID NO: 2557 - DNA, 17 bp; single-stranded, linear
uuuuuuuuuuccaaauc

SEQ ID NO: 2558 - DNA, 17 bp; single-stranded, linear
uuuuuuuuuccaaauca

SEQ ID NO: 2559 - DNA, 17 bp; single-stranded, linear
uuuuuuuuccaaaucag

SEQ ID NO: 2560 - DNA, 17 bp; single-stranded, linear
uuccaaaucagauaaua

SEQ ID NO: 2561 - DNA, 17 bp; single-stranded, linear
aaucagauaauagccca

SEQ ID NO: 2562 - DNA, 17 bp; single-stranded, linear
cagauaauagcccagca

SEQ ID NO: 2563 - DNA, 17 bp; single-stranded, linear
cagcaaauagugauaac

SEQ ID NO: 2564 - DNA, 17 bp; single-stranded, linear
auagugauaacaaauaa

SEQ ID NO: 2565 - DNA, 17 bp; single-stranded, linear
uaacaaauaaaaccuua

SEQ ID NO: 2566 - DNA, 17 bp; single-stranded, linear
uaaaaccuuagcuguuc

SEQ ID NO: 2567 - DNA, 17 bp; single-stranded, linear
aaaaccuuagcuguuca

SEQ ID NO: 2568 - DNA, 17 bp; single-stranded, linear
uuagcuguucaugucuu

SEQ ID NO: 2569 - DNA, 17 bp; single-stranded, linear
uagcuguucaugucuug

SEQ ID NO: 2570 - DNA, 17 bp; single-stranded, linear
guucaugucuugauuuc

SEQ ID NO: 2571 - DNA, 17 bp; single-stranded, linear
ucaugucuugauuucaa

SEQ ID NO: 2572 - DNA, 17 bp; single-stranded, linear
gucuugauuucaauaau

SEQ ID NO: 2573 - DNA, 17 bp; single-stranded, linear
ucuugauuucaauaauu

SEQ ID NO: 2574 - DNA, 17 bp; single-stranded, linear
cuugauuucaauaauua

SEQ ID NO: 2575 - DNA, 17 bp; single-stranded, linear
auuucaauaauuaauuc

SEQ ID NO: 2576 - DNA, 17 bp; single-stranded, linear
ucaauaauuaauucuua

SEQ ID NO: 2577 - DNA, 17 bp; single-stranded, linear
caauaauuaauucuuaa

SEQ ID NO: 2578 - DNA, 17 bp; single-stranded, linear
uaauuaauucuuaauca

SEQ ID NO: 2579 - DNA, 17 bp; single-stranded, linear
aauuaauucuuaaucau

SEQ ID NO: 2580 - DNA, 17 bp; single-stranded, linear
uuaauucuuaaucauua

SEQ ID NO: 2581 - DNA, 17 bp; single-stranded, linear
uaauucuuaaucauuaa

SEQ ID NO: 2582 - DNA, 17 bp; single-stranded, linear
uucuuaaucauuaagag

SEQ ID NO: 2583 - DNA, 17 bp; single-stranded, linear
uuaaucauuaagagacc

SEQ ID NO: 2584 - DNA, 17 bp; single-stranded, linear
uaaucauuaagagacca

SEQ ID NO: 2585 - DNA, 17 bp; single-stranded, linear
gagaccauaauaaauac

SEQ ID NO: 2586 - DNA, 17 bp; single-stranded, linear
accauaauaaauacucc

SEQ ID NO: 2587 - DNA, 17 bp; single-stranded, linear
uaauaaauacuccuuuu

SEQ ID NO: 2588 - DNA, 17 bp; single-stranded, linear
uaaauacuccuuuucaa

SEQ ID NO: 2589 - DNA, 17 bp; single-stranded, linear
auacuccuuuucaagag

SEQ ID NO: 2590 - DNA, 17 bp; single-stranded, linear
uacuccuuuucaagaga

SEQ ID NO: 2591 - DNA, 17 bp; single-stranded, linear
acuccuuuucaagagaa

SEQ ID NO: 2592 - DNA, 17 bp; single-stranded, linear
cuccuuuucaagagaaa

SEQ ID NO: 2593 - DNA, 17 bp; single-stranded, linear
aaaaccauuagaauugu

SEQ ID NO: 2594 - DNA, 17 bp; single-stranded, linear
aaaccauuagaauuguu

SEQ ID NO: 2595 - DNA, 17 bp; single-stranded, linear
auuagaauuguuacuca

SEQ ID NO: 2596 - DNA, 17 bp; single-stranded, linear
agaauuguuacucagcu

SEQ ID NO: 2597 - DNA, 17 bp; single-stranded, linear
gaauuguuacucagcuc

SEQ ID NO: 2598 - DNA, 17 bp; single-stranded, linear
uuguuacucagcuccuu

SEQ ID NO: 2599 - DNA, 17 bp; single-stranded, linear
acucagcuccuucaaac

SEQ ID NO: 2600 - DNA, 17 bp; single-stranded, linear
cagcuccuucaaacuca

SEQ ID NO: 2601 - DNA, 17 bp; single-stranded, linear
agcuccuucaaacucag

SEQ ID NO: 2602 - DNA, 17 bp; single-stranded, linear
uucaaacucagguuugu

SEQ ID NO: 2603 - DNA, 17 bp; single-stranded, linear
acucagguuuguagcau

SEQ ID NO: 2604 - DNA, 17 bp; single-stranded, linear
cucagguuuguagcaua

SEQ ID NO: 2605 - DNA, 17 bp; single-stranded, linear
agguuuguagcauacau

SEQ ID NO: 2606 - DNA, 17 bp; single-stranded, linear
uguagcauacaugaguc

SEQ ID NO: 2607 - DNA, 17 bp; single-stranded, linear
acaugaguccauccauc

SEQ ID NO: 2608 - DNA, 17 bp; single-stranded, linear
gaguccauccaucaguc

SEQ ID NO: 2609 - DNA, 17 bp; single-stranded, linear
ccauccaucagucaaag

SEQ ID NO: 2610 - DNA, 17 bp; single-stranded, linear
ccaucagucaaagaaug

SEQ ID NO: 2611 - DNA, 17 bp; single-stranded, linear
agaaugguuccaucugg

SEQ ID NO: 2612 - DNA, 17 bp; single-stranded, linear
gaaugguuccaucugga

SEQ ID NO: 2613 - DNA, 17 bp; single-stranded, linear
gguuccaucuggagucu

SEQ ID NO: 2614 - DNA, 17 bp; single-stranded, linear
ucuggagucuuaaugua

SEQ ID NO: 2615 - DNA, 17 bp; single-stranded, linear
uggagucuuaauguaga

SEQ ID NO: 2616 - DNA, 17 bp; single-stranded, linear
ggagucuuaauguagaa

SEQ ID NO: 2617 - DNA, 17 bp; single-stranded, linear
cuuaauguagaaagaaa

SEQ ID NO: 2618 - DNA, 17 bp; single-stranded, linear
uggagacuuguaauaau

SEQ ID NO: 2619 - DNA, 17 bp; single-stranded, linear
agacuuguaauaaugag

SEQ ID NO: 2620 - DNA, 17 bp; single-stranded, linear
cuuguaauaaugagcua

SEQ ID NO: 2621 - DNA, 17 bp; single-stranded, linear
aaugagcuaguuacaaa

SEQ ID NO: 2622 - DNA, 17 bp; single-stranded, linear
gagcuaguuacaaagug

SEQ ID NO: 2623 - DNA, 17 bp; single-stranded, linear
agcuaguuacaaagugc

SEQ ID NO: 2624 - DNA, 17 bp; single-stranded, linear
aaagugcuuguucauua

SEQ ID NO: 2625 - DNA, 17 bp; single-stranded, linear
gugcuuguucauuaaaa

SEQ ID NO: 2626 - DNA, 17 bp; single-stranded, linear
ugcuuguucauuaaaau

SEQ ID NO: 2627 - DNA, 17 bp; single-stranded, linear
uuguucauuaaaauagc

SEQ ID NO: 2628 - DNA, 17 bp; single-stranded, linear
uguucauuaaaauagca

SEQ ID NO: 2629 - DNA, 17 bp; single-stranded, linear
auuaaaauagcacugaa

SEQ ID NO: 2630 - DNA, 17 bp; single-stranded, linear
cugaaaauugaaacaug

SEQ ID NO: 2631 - DNA, 17 bp; single-stranded, linear
acaugaauuaacugaua

SEQ ID NO: 2632 - DNA, 17 bp; single-stranded, linear
caugaauuaacugauaa

SEQ ID NO: 2633 - DNA, 17 bp; single-stranded, linear
uaacugauaauauucca

SEQ ID NO: 2634 - DNA, 17 bp; single-stranded, linear
cugauaauauuccaauc

SEQ ID NO: 2635 - DNA, 17 bp; single-stranded, linear
gauaauauuccaaucau

SEQ ID NO: 2636 - DNA, 17 bp; single-stranded, linear
auaauauuccaaucauu

SEQ ID NO: 2637 - DNA, 17 bp; single-stranded, linear
auuccaaucauuugcca

SEQ ID NO: 2638 - DNA, 17 bp; single-stranded, linear
ccaaucauuugccauuu

SEQ ID NO: 2639 - DNA, 17 bp; single-stranded, linear
caaucauuugccauuua

SEQ ID NO: 2640 - DNA, 17 bp; single-stranded, linear
uuugccauuuaugacaa

SEQ ID NO: 2641 - DNA, 17 bp; single-stranded, linear
uugccauuuaugacaaa

SEQ ID NO: 2642 - DNA, 17 bp; single-stranded, linear
ugccauuuaugacaaaa

SEQ ID NO: 2643 - DNA, 17 bp; single-stranded, linear
aaaaugguuggcacuaa

SEQ ID NO: 2644 - DNA, 17 bp; single-stranded, linear
uuggcacuaacaaagaa

SEQ ID NO: 2645 - DNA, 17 bp; single-stranded, linear
cgagcacuuccuuucag

SEQ ID NO: 2646 - DNA, 17 bp; single-stranded, linear
gagcacuuccuuucaga

SEQ ID NO: 2647 - DNA, 17 bp; single-stranded, linear
cacuuccuuucagaguu

SEQ ID NO: 2648 - DNA, 17 bp; single-stranded, linear
acuuccuuucagaguuu

SEQ ID NO: 2649 - DNA, 17 bp; single-stranded, linear
cuuccuuucagaguuuc

SEQ ID NO: 2650 - DNA, 17 bp; single-stranded, linear
uucagaguuucugagau

SEQ ID NO: 2651 - DNA, 17 bp; single-stranded, linear
ucagaguuucugagaua

SEQ ID NO: 2652 - DNA, 17 bp; single-stranded, linear
cagaguuucugagauaa

SEQ ID NO: 2653 - DNA, 17 bp; single-stranded, linear
ucugagauaauguacgu

SEQ ID NO: 2654 - DNA, 17 bp; single-stranded, linear
gauaauguacguggaac

SEQ ID NO: 2655 - DNA, 17 bp; single-stranded, linear
ggaacagucugggugga

SEQ ID NO: 2656 - DNA, 17 bp; single-stranded, linear
gugcaagucugugucuu

SEQ ID NO: 2657 - DNA, 17 bp; single-stranded, linear
gucugugucuugucagu

SEQ ID NO: 2658 - DNA, 17 bp; single-stranded, linear
cugugucuugucagucc

SEQ ID NO: 2659 - DNA, 17 bp; single-stranded, linear
ugucuugucaguccaag

SEQ ID NO: 2660 - DNA, 17 bp; single-stranded, linear
uugucaguccaagaagu

SEQ ID NO: 2661 - DNA, 17 bp; single-stranded, linear
cgagauguuaauuuuag

SEQ ID NO: 2662 - DNA, 17 bp; single-stranded, linear
gagauguuaauuuuagg

SEQ ID NO: 2663 - DNA, 17 bp; single-stranded, linear
auguuaauuuuagggac

SEQ ID NO: 2664 - DNA, 17 bp; single-stranded, linear
uguuaauuuuagggacc

SEQ ID NO: 2665 - DNA, 17 bp; single-stranded, linear
guuaauuuuagggaccc

SEQ ID NO: 2666 - DNA, 17 bp; single-stranded, linear
uuaauuuuagggacccg

SEQ ID NO: 2667 - DNA, 17 bp; single-stranded, linear
ccgugccuuguuuccua

SEQ ID NO: 2668 - DNA, 17 bp; single-stranded, linear
ugccuuguuuccuagcc

SEQ ID NO: 2669 - DNA, 17 bp; single-stranded, linear
gccuuguuuccuagccc

SEQ ID NO: 2670 - DNA, 17 bp; single-stranded, linear
ccuuguuuccuagccca

SEQ ID NO: 2671 - DNA, 17 bp; single-stranded, linear
uguuuccuagcccacaa

SEQ ID NO: 2672 - DNA, 17 bp; single-stranded, linear
gcaaacaucaaacagau

SEQ ID NO: 2673 - DNA, 17 bp; single-stranded, linear
aaacagauacucgcuag

SEQ ID NO: 2674 - DNA, 17 bp; single-stranded, linear
cagauacucgcuagccu

SEQ ID NO: 2675 - DNA, 17 bp; single-stranded, linear
uacucgcuagccucauu

SEQ ID NO: 2676 - DNA, 17 bp; single-stranded, linear
gcuagccucauuuaaau

SEQ ID NO: 2677 - DNA, 17 bp; single-stranded, linear
agccucauuuaaauuga

SEQ ID NO: 2678 - DNA, 17 bp; single-stranded, linear
gccucauuuaaauugau

SEQ ID NO: 2679 - DNA, 17 bp; single-stranded, linear
ccucauuuaaauugauu

SEQ ID NO: 2680 - DNA, 17 bp; single-stranded, linear
auuuaaauugauuaaag

SEQ ID NO: 2681 - DNA, 17 bp; single-stranded, linear
aaauugauuaaaggagg

SEQ ID NO: 2682 - DNA, 17 bp; single-stranded, linear
aauugauuaaaggagga

SEQ ID NO: 2683 - DNA, 17 bp; single-stranded, linear
gagugcaucuuuggccg

SEQ ID NO: 2684 - DNA, 17 bp; single-stranded, linear
gugcaucuuuggccgac

SEQ ID NO: 2685 - DNA, 17 bp; single-stranded, linear
ugcaucuuuggccgaca

SEQ ID NO: 2686 - DNA, 17 bp; single-stranded, linear
agugguguaacugugug

SEQ ID NO: 2687 - DNA, 17 bp; single-stranded, linear
guggguguauguguguu

SEQ ID NO: 2688 - DNA, 17 bp; single-stranded, linear
auguguguuuugugcau

SEQ ID NO: 2689 - DNA, 17 bp; single-stranded, linear
uguguguuuugugcaua

SEQ ID NO: 2690 - DNA, 17 bp; single-stranded, linear
guguguuuugugcauaa

SEQ ID NO: 2691 - DNA, 17 bp; single-stranded, linear
uugugcauaacuauuua

SEQ ID NO: 2692 - DNA, 17 bp; single-stranded, linear
gcauaacuauuuaagga

SEQ ID NO: 2693 - DNA, 17 bp; single-stranded, linear
auaacuauuuaaggaaa

SEQ ID NO: 2694 - DNA, 17 bp; single-stranded, linear
uaacuauuuaaggaaac

SEQ ID NO: 2695 - DNA, 17 bp; single-stranded, linear
aacuauuuaaggaaacu

SEQ ID NO: 2696 - DNA, 17 bp; single-stranded, linear
acuggaauuuuaaaguu

SEQ ID NO: 2697 - DNA, 17 bp; single-stranded, linear
cuggaauuuuaaaguua

SEQ ID NO: 2698 - DNA, 17 bp; single-stranded, linear
uggaauuuuaaaguuac

SEQ ID NO: 2699 - DNA, 17 bp; single-stranded, linear
ggaauuuuaaaguuacu

SEQ ID NO: 2700 - DNA, 17 bp; single-stranded, linear
uuuaaaguuacuuuuau

SEQ ID NO: 2701 - DNA, 17 bp; single-stranded, linear
uuaaaguuacuuuuaua

SEQ ID NO: 2702 - DNA, 17 bp; single-stranded, linear
aaguuacuuuuauacaa

SEQ ID NO: 2703 - DNA, 17 bp; single-stranded, linear
aguuacuuuuauacaaa

SEQ ID NO: 2704 - DNA, 17 bp; single-stranded, linear
guuacuuuuauacaaac

SEQ ID NO: 2705 - DNA, 17 bp; single-stranded, linear
uuacuuuuauacaaacc

SEQ ID NO: 2706 - DNA, 17 bp; single-stranded, linear
acuuuuauacaaaccaa

SEQ ID NO: 2707 - DNA, 17 bp; single-stranded, linear
ccaagaauauaugcuac

SEQ ID NO: 2708 - DNA, 17 bp; single-stranded, linear
aagaauauaugcuacag

SEQ ID NO: 2709 - DNA, 17 bp; single-stranded, linear
uauaugcuacagauaua

SEQ ID NO: 2710 - DNA, 17 bp; single-stranded, linear
cuacagauauaagacag

SEQ ID NO: 2711 - DNA, 17 bp; single-stranded, linear
acagauauaagacagac

SEQ ID NO: 2712 - DNA, 17 bp; single-stranded, linear
gacaugguuugguccua

SEQ ID NO: 2713 - DNA, 17 bp; single-stranded, linear
acaugguuugguccuau

SEQ ID NO: 2714 - DNA, 17 bp; single-stranded, linear
gguuugguccuauauuu

SEQ ID NO: 2715 - DNA, 17 bp; single-stranded, linear
uugguccuauauuucua

SEQ ID NO: 2716 - DNA, 17 bp; single-stranded, linear
gguccuauauuucuagu

SEQ ID NO: 2717 - DNA, 17 bp; single-stranded, linear
uccuauauuucuaguca

SEQ ID NO: 2718 - DNA, 17 bp; single-stranded, linear
ccuauauuucuagucau

SEQ ID NO: 2719 - DNA, 17 bp; single-stranded, linear
cuauauuucuagucaug

SEQ ID NO: 2720 - DNA, 17 bp; single-stranded, linear
auauuucuagucaugau

SEQ ID NO: 2721 - DNA, 17 bp; single-stranded, linear
uuucuagucaugaugaa

SEQ ID NO: 2722 - DNA, 17 bp; single-stranded, linear
augaauguauuuuguau

SEQ ID NO: 2723 - DNA, 17 bp; single-stranded, linear
gaauguauuuuguauac

SEQ ID NO: 2724 - DNA, 17 bp; single-stranded, linear
aauguauuuuguauacc

SEQ ID NO: 2725 - DNA, 17 bp; single-stranded, linear
auguauuuuguauacca

SEQ ID NO: 2726 - DNA, 17 bp; single-stranded, linear
uauuuuguauaccaucu

SEQ ID NO: 2727 - DNA, 17 bp; single-stranded, linear
uuuuguauaccaucuuc

SEQ ID NO: 2728 - DNA, 17 bp; single-stranded, linear
uauaccaucuucauaua

SEQ ID NO: 2729 - DNA, 17 bp; single-stranded, linear
uaccaucuucauauaau

SEQ ID NO: 2730 - DNA, 17 bp; single-stranded, linear
accaucuucauauaaua

SEQ ID NO: 2731 - DNA, 17 bp; single-stranded, linear
aucuucauauaauauac

SEQ ID NO: 2732 - DNA, 17 bp; single-stranded, linear
cuucauauaauauacuu

SEQ ID NO: 2733 - DNA, 17 bp; single-stranded, linear
cauauaauauacuuaaa

SEQ ID NO: 2734 - DNA, 17 bp; single-stranded, linear
uauaauauacuuaaaaa

SEQ ID NO: 2735 - DNA, 17 bp; single-stranded, linear
aauauacuuaaaaauau

SEQ ID NO: 2736 - DNA, 17 bp; single-stranded, linear
auauacuuaaaaauauu

SEQ ID NO: 2737 - DNA, 17 bp; single-stranded, linear
uuaaaaauauuucuuaa

SEQ ID NO: 2738 - DNA, 17 bp; single-stranded, linear
aaaaauauuucuuaauu

SEQ ID NO: 2739 - DNA, 17 bp; single-stranded, linear
aaaauauuucuuaauug

SEQ ID NO: 2740 - DNA, 17 bp; single-stranded, linear
aaauauuucuuaauugg

SEQ ID NO: 2741 - DNA, 17 bp; single-stranded, linear
auauuucuuaauuggga

SEQ ID NO: 2742 - DNA, 17 bp; single-stranded, linear
uauuucuuaauugggau

SEQ ID NO: 2743 - DNA, 17 bp; single-stranded, linear
uucuuaauugggauuug

SEQ ID NO: 2744 - DNA, 17 bp; single-stranded, linear
auugggauuuguaaucg

SEQ ID NO: 2745 - DNA, 17 bp; single-stranded, linear
uugggauuuguaaucgu

SEQ ID NO: 2746 - DNA, 17 bp; single-stranded, linear
ggauuuguaaucguacc

SEQ ID NO: 2747 - DNA, 17 bp; single-stranded, linear
uuuguaaucguaccaac

SEQ ID NO: 2748 - DNA, 17 bp; single-stranded, linear
guaaucguaccaacuua

SEQ ID NO: 2749 - DNA, 17 bp; single-stranded, linear
uaccaacuuaauugaua

SEQ ID NO: 2750 - DNA, 17 bp; single-stranded, linear
accaacuuaauugauaa

SEQ ID NO: 2751 - DNA, 17 bp; single-stranded, linear
aacuuaauugauaaacu

SEQ ID NO: 2752 - DNA, 17 bp; single-stranded, linear
uaauugauaaacuuggc

SEQ ID NO: 2753 - DNA, 17 bp; single-stranded, linear
gauaaacuuggcaacug

SEQ ID NO: 2754 - DNA, 17 bp; single-stranded, linear
caacugcuuuuauguuc

SEQ ID NO: 2755 - DNA, 17 bp; single-stranded, linear
aacugcuuuuauguucu

SEQ ID NO: 2756 - DNA, 17 bp; single-stranded, linear
acugcuuuuauguucug

SEQ ID NO: 2757 - DNA, 17 bp; single-stranded, linear
cugcuuuuauguucugu

SEQ ID NO: 2758 - DNA, 17 bp; single-stranded, linear
uuuuauguucugucucc

SEQ ID NO: 2759 - DNA, 17 bp; single-stranded, linear
uuuauguucugucuccu

SEQ ID NO: 2760 - DNA, 17 bp; single-stranded, linear
uguucugucuccuucca

SEQ ID NO: 2761 - DNA, 17 bp; single-stranded, linear
uucugucuccuuccaua

SEQ ID NO: 2762 - DNA, 17 bp; single-stranded, linear
ugucuccuuccauaaau

SEQ ID NO: 2763 - DNA, 17 bp; single-stranded, linear
gucuccuuccauaaauu

SEQ ID NO: 2764 - DNA, 17 bp; single-stranded, linear
ccuuccauaaauuuuuc

SEQ ID NO: 2765 - DNA, 17 bp; single-stranded, linear
ccauaaauuuuucaaaa

SEQ ID NO: 2766 - DNA, 17 bp; single-stranded, linear
cauaaauuuuucaaaau

SEQ ID NO: 2767 - DNA, 17 bp; single-stranded, linear
auaaauuuuucaaaaua

SEQ ID NO: 2768 - DNA, 17 bp; single-stranded, linear
uaaauuuuucaaaauac

SEQ ID NO: 2769 - DNA, 17 bp; single-stranded, linear
aaauuuuucaaaauacu

SEQ ID NO: 2770 - DNA, 17 bp; single-stranded, linear
uucaaaauacuaauuca

SEQ ID NO: 2771 - DNA, 17 bp; single-stranded, linear
aaaauacuaauucaaca

SEQ ID NO: 2772 - DNA, 17 bp; single-stranded, linear
auacuaauucaacaaag

SEQ ID NO: 2773 - DNA, 17 bp; single-stranded, linear
uacuaauucaacaaaga

SEQ ID NO: 2774 - DNA, 17 bp; single-stranded, linear
aaaaagcucuuuuuuuu

SEQ ID NO: 2775 - DNA, 17 bp; single-stranded, linear
aaagcucuuuuuuuucc

SEQ ID NO: 2776 - DNA, 17 bp; single-stranded, linear
aagcucuuuuuuuuccu

SEQ ID NO: 2777 - DNA, 17 bp; single-stranded, linear
agcucuuuuuuuuccua

SEQ ID NO: 2778 - DNA, 17 bp; single-stranded, linear
gcucuuuuuuuuccuaa

SEQ ID NO: 2779 - DNA, 17 bp; single-stranded, linear
cucuuuuuuuuccuaaa

SEQ ID NO: 2780 - DNA, 17 bp; single-stranded, linear
ucuuuuuuuuccuaaaa

SEQ ID NO: 2781 - DNA, 17 bp; single-stranded, linear
cuuuuuuuuccuaaaau

SEQ ID NO: 2782 - DNA, 17 bp; single-stranded, linear
uuuuuuuuccuaaaaua

SEQ ID NO: 2783 - DNA, 17 bp; single-stranded, linear
uuuuuccuaaaauaaac

SEQ ID NO: 2784 - DNA, 17 bp; single-stranded, linear
ccuaaaauaaacucaaa

SEQ ID NO: 2785 - DNA, 17 bp; single-stranded, linear
aauaaacucaaauuuau

SEQ ID NO: 2786 - DNA, 17 bp; single-stranded, linear
acucaaauuuauccuug

SEQ ID NO: 2787 - DNA, 17 bp; single-stranded, linear
cucaaauuuauccuugu

SEQ ID NO: 2788 - DNA, 17 bp; single-stranded, linear
ucaaauuuauccuuguu

SEQ ID NO: 2789 - DNA, 17 bp; single-stranded, linear
aaauuuauccuuguuua

SEQ ID NO: 2790 - DNA, 17 bp; single-stranded, linear
uuuauccuuguuuagag

SEQ ID NO: 2791 - DNA, 17 bp; single-stranded, linear
auccuuguuuagagcag

SEQ ID NO: 2792 - DNA, 17 bp; single-stranded, linear
uccuuguuuagagcaga

SEQ ID NO: 2793 - DNA, 17 bp; single-stranded, linear
ccuuguuuagagcagag

SEQ ID NO: 2794 - DNA, 17 bp; single-stranded, linear
agaaaaauuaagaaaaa

SEQ ID NO: 2795 - DNA, 17 bp; single-stranded, linear
gaaaaauuaagaaaaac

SEQ ID NO: 2796 - DNA, 17 bp; single-stranded, linear
gaaaaacuuugaaaugg

SEQ ID NO: 2797 - DNA, 17 bp; single-stranded, linear
aaaaacuuugaaauggu

SEQ ID NO: 2798 - DNA, 17 bp; single-stranded, linear
gaaauggucucaaaaaa

SEQ ID NO: 2799 - DNA, 17 bp; single-stranded, linear
aauggucucaaaaaauu

SEQ ID NO: 2800 - DNA, 17 bp; single-stranded, linear
caaaaaauugcuaaaua

SEQ ID NO: 2801 - DNA, 17 bp; single-stranded, linear
aaauugcuaaauauuuu

SEQ ID NO: 2802 - DNA, 17 bp; single-stranded, linear
ugcuaaauauuuucaau

SEQ ID NO: 2803 - DNA, 17 bp; single-stranded, linear
cuaaauauuuucaaugg

SEQ ID NO: 2804 - DNA, 17 bp; single-stranded, linear
uaaauauuuucaaugga

SEQ ID NO: 2805 - DNA, 17 bp; single-stranded, linear
aaauauuuucaauggaa

SEQ ID NO: 2806 - DNA, 17 bp; single-stranded, linear
aauauuuucaauggaaa

SEQ ID NO: 2807 - DNA, 17 bp; single-stranded, linear
ggaaaacuaaauguuag

SEQ ID NO: 2808 - DNA, 17 bp; single-stranded, linear
cuaaauguuaguuuagc

SEQ ID NO: 2809 - DNA, 17 bp; single-stranded, linear
uaaauguuaguuuagcu

SEQ ID NO: 2810 - DNA, 17 bp; single-stranded, linear
auguuaguuuagcugau

SEQ ID NO: 2811 - DNA, 17 bp; single-stranded, linear
uguuaguuuagcugauu

SEQ ID NO: 2812 - DNA, 17 bp; single-stranded, linear
guuaguuuagcugauug

SEQ ID NO: 2813 - DNA, 17 bp; single-stranded, linear
uagcugauuguaugggg

SEQ ID NO: 2814 - DNA, 17 bp; single-stranded, linear
cugauuguaugggguuu

SEQ ID NO: 2815 - DNA, 17 bp; single-stranded, linear
uaugggguuuucgaacc

SEQ ID NO: 2816 - DNA, 17 bp; single-stranded, linear
augggguuuucgaaccu

SEQ ID NO: 2817 - DNA, 17 bp; single-stranded, linear
ugggguuuucgaaccuu

SEQ ID NO: 2818 - DNA, 17 bp; single-stranded, linear
gggguuuucgaaccuuu

SEQ ID NO: 2819 - DNA, 17 bp; single-stranded, linear
ucgaaccuuucacuuuu

SEQ ID NO: 2820 - DNA, 17 bp; single-stranded, linear
cgaaccuuucacuuuuu

SEQ ID NO: 2821 - DNA, 17 bp; single-stranded, linear
gaaccuuucacuuuuug

SEQ ID NO: 2822 - DNA, 17 bp; single-stranded, linear
cuuucacuuuuuguuug

SEQ ID NO: 2823 - DNA, 17 bp; single-stranded, linear
uuucacuuuuuguuugu

SEQ ID NO: 2824 - DNA, 17 bp; single-stranded, linear
uucacuuuuuguuuguu

SEQ ID NO: 2825 - DNA, 17 bp; single-stranded, linear
ucacuuuuuguuuguuu

SEQ ID NO: 2826 - DNA, 17 bp; single-stranded, linear
cuuuuuguuuguuuuac

SEQ ID NO: 2827 - DNA, 17 bp; single-stranded, linear
uuuuuguuuguuuuacc

SEQ ID NO: 2828 - DNA, 17 bp; single-stranded, linear
uuguuuguuuuaccuau

SEQ ID NO: 2829 - DNA, 17 bp; single-stranded, linear
uguuuguuuuaccuauu

SEQ ID NO: 2830 - DNA, 17 bp; single-stranded, linear
guuuguuuuaccuauuu

SEQ ID NO: 2831 - DNA, 17 bp; single-stranded, linear
uuuguuuuaccuauuuc

SEQ ID NO: 2832 - DNA, 17 bp; single-stranded, linear
uuuuaccuauuucacaa

SEQ ID NO: 2833 - DNA, 17 bp; single-stranded, linear
uuaccuauuucacaacu

SEQ ID NO: 2834 - DNA, 17 bp; single-stranded, linear
uaccuauuucacaacug

SEQ ID NO: 2835 - DNA, 17 bp; single-stranded, linear
accuauuucacaacugu

SEQ ID NO: 2836 - DNA, 17 bp; single-stranded, linear
aacuguguaaauugcca

SEQ ID NO: 2837 - DNA, 17 bp; single-stranded, linear
guguaaauugccaauaa

SEQ ID NO: 2838 - DNA, 17 bp; single-stranded, linear
uugccaauaauuccugu

SEQ ID NO: 2839 - DNA, 17 bp; single-stranded, linear
ccaauaauuccugucca

SEQ ID NO: 2840 - DNA, 17 bp; single-stranded, linear
caauaauuccuguccau

SEQ ID NO: 2841 - DNA, 17 bp; single-stranded, linear
auuccuguccaugaaaa

SEQ ID NO: 2842 - DNA, 17 bp; single-stranded, linear
augcaaauuauccagug

SEQ ID NO: 2843 - DNA, 17 bp; single-stranded, linear
ugcaaauuauccagugu

SEQ ID NO: 2844 - DNA, 17 bp; single-stranded, linear
caaauuauccaguguag

SEQ ID NO: 2845 - DNA, 17 bp; single-stranded, linear
uccaguguagauauauu

SEQ ID NO: 2846 - DNA, 17 bp; single-stranded, linear
guguagauauauuugac

SEQ ID NO: 2847 - DNA, 17 bp; single-stranded, linear
guagauauauuugacca

SEQ ID NO: 2848 - DNA, 17 bp; single-stranded, linear
agauauauuugaccauc

SEQ ID NO: 2849 - DNA, 17 bp; single-stranded, linear
gauauauuugaccauca

SEQ ID NO: 2850 - DNA, 17 bp; single-stranded, linear
uugaccaucacccuaug

SEQ ID NO: 2851 - DNA, 17 bp; single-stranded, linear
aucacccuauggauauu

SEQ ID NO: 2852 - DNA, 17 bp; single-stranded, linear
cuauggauauuggcuag

SEQ ID NO: 2853 - DNA, 17 bp; single-stranded, linear
auggauauuggcuaguu

SEQ ID NO: 2854 - DNA, 17 bp; single-stranded, linear
uauuggcuaguuuugcc

SEQ ID NO: 2855 - DNA, 17 bp; single-stranded, linear
uggcuaguuuugccuuu

SEQ ID NO: 2856 - DNA, 17 bp; single-stranded, linear
ggcuaguuuugccuuua

SEQ ID NO: 2857 - DNA, 17 bp; single-stranded, linear
gcuaguuuugccuuuau

SEQ ID NO: 2858 - DNA, 17 bp; single-stranded, linear
uuuugccuuuauuaagc

SEQ ID NO: 2859 - DNA, 17 bp; single-stranded, linear
uuugccuuuauuaagca

SEQ ID NO: 2860 - DNA, 17 bp; single-stranded, linear
uugccuuuauuaagcaa

SEQ ID NO: 2861 - DNA, 17 bp; single-stranded, linear
gccuuuauuaagcaaau

SEQ ID NO: 2862 - DNA, 17 bp; single-stranded, linear
ccuuuauuaagcaaauu

SEQ ID NO: 2863 - DNA, 17 bp; single-stranded, linear
aagcaaauucauuucag

SEQ ID NO: 2864 - DNA, 17 bp; single-stranded, linear
agcaaauucauuucagc

SEQ ID NO: 2865 - DNA, 17 bp; single-stranded, linear
aaauucauuucagccug

SEQ ID NO: 2866 - DNA, 17 bp; single-stranded, linear
aauucauuucagccuga

SEQ ID NO: 2867 - DNA, 17 bp; single-stranded, linear
auucauuucagccugaa

SEQ ID NO: 2868 - DNA, 17 bp; single-stranded, linear
cugaaugucugccuaua

SEQ ID NO: 2869 - DNA, 17 bp; single-stranded, linear
gucugccuauauauucu

SEQ ID NO: 2870 - DNA, 17 bp; single-stranded, linear
cugccuauauauucucu

SEQ ID NO: 2871 - DNA, 17 bp; single-stranded, linear
gccuauauauucucugc

SEQ ID NO: 2872 - DNA, 17 bp; single-stranded, linear
cuauauauucucugcuc

SEQ ID NO: 2873 - DNA, 17 bp; single-stranded, linear
uauauauucucugcucu

SEQ ID NO: 2874 - DNA, 17 bp; single-stranded, linear
uauauucucugcucuuu

SEQ ID NO: 2875 - DNA, 17 bp; single-stranded, linear
ucucugcucuuuguauu

SEQ ID NO: 2876 - DNA, 17 bp; single-stranded, linear
ucugcucuuuguauucu

SEQ ID NO: 2877 - DNA, 17 bp; single-stranded, linear
cugcucuuuguauucuc

SEQ ID NO: 2878 - DNA, 17 bp; single-stranded, linear
cucuuuguauucuccuu

SEQ ID NO: 2879 - DNA, 17 bp; single-stranded, linear
cuuuguauucuccuuug

SEQ ID NO: 2880 - DNA, 17 bp; single-stranded, linear
uuuguauucuccuuuga

SEQ ID NO: 2881 - DNA, 17 bp; single-stranded, linear
uguauucuccuuugaac

SEQ ID NO: 2882 - DNA, 17 bp; single-stranded, linear
auucuccuuugaacccg

SEQ ID NO: 2883 - DNA, 17 bp; single-stranded, linear
uucuccuuugaacccgu

SEQ ID NO: 2884 - DNA, 17 bp; single-stranded, linear
gaacccguuaaaacauc

SEQ ID NO: 2885 - DNA, 17 bp; single-stranded, linear
aacccguuaaaacaucc

SEQ ID NO: 2886 - DNA, 17 bp; single-stranded, linear
uaaaacauccuguggca

SEQ ID NO: 2887 - DNA, 54 bp; single-stranded, linear
cggggaggagaagagaggaccagagaaacacacguugugguacauuaccuggua

SEQ ID NO: 2888 - DNA, 54 bp; single-stranded, linear
ccgcuccgagaagccgccaccagagaaacacacguugugguacauuaccuggua

SEQ ID NO: 2889 - DNA, 54 bp; single-stranded, linear
ccgccagaagaaguccucaccagagaaacacacguugugguacauuaccuggua

SEQ ID NO: 2890 - DNA, 54 bp; single-stranded, linear
aacgacccagaagccagaaccagagaaacacacguugugguacauuaccuggua

SEQ ID NO: 2891 - DNA, 54 bp; single-stranded, linear
gcgcgcacagaaggacccaccagagaaacacacguugugguacauuaccuggua

SEQ ID NO: 2892 - DNA, 54 bp; single-stranded, linear
gacagcugagaagcgcgcaccagagaaacacacguugugguacauuaccuggua

SEQ ID NO: 2893 - DNA, 54 bp; single-stranded, linear
aagcagacagaagagcagaccagagaaacacacguugugguacauuaccuggua

SEQ ID NO: 2894 - DNA, 54 bp; single-stranded, linear
gagaagcaagaagcugagaccagagaaacacacguugugguacauuaccuggua

SEQ ID NO: 2895 - DNA, 54 bp; single-stranded, linear
cugugagaagaagacagcaccagagaaacacacguugugguacauuaccuggua

SEQ ID NO: 2896 - DNA, 54 bp; single-stranded, linear
cauuuaugagaagcuuccaccagagaaacacacguugugguacauuaccuggua

SEQ ID NO: 2897 - DNA, 54 bp; single-stranded, linear
cuuccacaagaagauuuaaccagagaaacacacguugugguacauuaccuggua

SEQ ID NO: 2898 - DNA, 54 bp; single-stranded, linear
uuugcuugagaaguguucaccagagaaacacacguugugguacauuaccuggua

SEQ ID NO: 2899 - DNA, 54 bp; single-stranded, linear
auauuugcagaaguagaaaccagagaaacacacguugugguacauuaccuggua

SEQ ID NO: 2900 - DNA, 54 bp; single-stranded, linear
cguaacccagaagggaauaccagagaaacacacguugugguacauuaccuggua

SEQ ID NO: 2901 - DNA, 54 bp; single-stranded, linear
cguuuuccagaagggaucaccagagaaacacacguugugguacauuaccuggua

SEQ ID NO: 2902 - DNA, 54 bp; single-stranded, linear
cuucacagagaagaagccaccagagaaacacacguugugguacauuaccuggua

SEQ ID NO: 2903 - DNA, 54 bp; single-stranded, linear
uuuuuuucagaaggguaaaccagagaaacacacguugugguacauuaccuggua

SEQ ID NO: 2904 - DNA, 54 bp; single-stranded, linear
gccgguaaagaagcuugcaccagagaaacacacguugugguacauuaccuggua

SEQ ID NO: 2905 - DNA, 54 bp; single-stranded, linear
ucauagagagaagguaagaccagagaaacacacguugugguacauuaccuggua

SEQ ID NO: 2906 - DNA, 54 bp; single-stranded, linear
aaauagcgagaagauuucaccagagaaacacacguugugguacauuaccuggua

SEQ ID NO: 2907 - DNA, 54 bp; single-stranded, linear
uuucguaaagaagggguuaccagagaaacacacguugugguacauuaccuggua

SEQ ID NO: 2908 - DNA, 54 bp; single-stranded, linear
agagccggagaaggaaacaccagagaaacacacguugugguacauuaccuggua

SEQ ID NO: 2909 - DNA, 54 bp; single-stranded, linear
ggguagagagaagggucuaccagagaaacacacguugugguacauuaccuggua

SEQ ID NO: 2910 - DNA, 54 bp; single-stranded, linear
cgguacaaagaaggauuuaccagagaaacacacguugugguacauuaccuggua

SEQ ID NO: 2911 - DNA, 54 bp; single-stranded, linear
auucuagaagaagccacaaccagagaaacacacguugugguacauuaccuggua

SEQ ID NO: 2912 - DNA, 54 bp; single-stranded, linear
uuuggcacagaagugauaaccagagaaacacacguugugguacauuaccuggua

SEQ ID NO: 2913 - DNA, 54 bp; single-stranded, linear
cuccuuccagaagcauuuaccagagaaacacacguugugguacauuaccuggua

SEQ ID NO: 2914 - DNA, 54 bp; single-stranded, linear
cugugcaaagaaguuucaaccagagaaacacacguugugguacauuaccuggua

SEQ ID NO: 2915 - DNA, 54 bp; single-stranded, linear
agugguggagaagcugauaccagagaaacacacguugugguacauuaccuggua

SEQ ID NO: 2916 - DNA, 54 bp; single-stranded, linear
accaagugagaagaggcuaccagagaaacacacguugugguacauuaccuggua

SEQ ID NO: 2917 - DNA, 54 bp; single-stranded, linear
uuucaauaagaagcgugcaccagagaaacacacguugugguacauuaccuggua

SEQ ID NO: 2918 - DNA, 54 bp; single-stranded, linear
guuccuugagaagugaggaccagagaaacacacguugugguacauuaccuggua

SEQ ID NO: 2919 - DNA, 54 bp; single-stranded, linear
uuagagugagaagcuccaaccagagaaacacacguugugguacauuaccuggua

SEQ ID NO: 2920 - DNA, 54 bp; single-stranded, linear
gauagguaagaagucuuuaccagagaaacacacguugugguacauuaccuggua

SEQ ID NO: 2921 - DNA, 54 bp; single-stranded, linear
ggaacuucagaaggguccaccagagaaacacacguugugguacauuaccuggua

SEQ ID NO: 2922 - DNA, 54 bp; single-stranded, linear
cauaagggagaagcucacaccagagaaacacacguugugguacauuaccuggua

SEQ ID NO: 2923 - DNA, 54 bp; single-stranded, linear
cagccacaagaaggcacgaccagagaaacacacguugugguacauuaccuggua

SEQ ID NO: 2924 - DNA, 54 bp; single-stranded, linear
gcucagucagaagagcuuaccagagaaacacacguugugguacauuaccuggua

SEQ ID NO: 2925 - DNA, 54 bp; single-stranded, linear
aggcucccagaagguuaaaccagagaaacacacguugugguacauuaccuggua

SEQ ID NO: 2926 - DNA, 54 bp; single-stranded, linear
caaucaccagaagaggccaccagagaaacacacguugugguacauuaccuggua

SEQ ID NO: 2927 - DNA, 54 bp; single-stranded, linear
uuccugaaagaaggagcuaccagagaaacacacguugugguacauuaccuggua

SEQ ID NO: 2928 - DNA, 54 bp; single-stranded, linear
uagaaaccagaagaauccaccagagaaacacacguugugguacauuaccuggua

SEQ ID NO: 2929 - DNA, 54 bp; single-stranded, linear
cuuguagaagaagucagaaccagagaaacacacguugugguacauuaccuggua

SEQ ID NO: 2930 - DNA, 54 bp; single-stranded, linear
uguaagaaagaagaucuuaccagagaaacacacguugugguacauuaccuggua

SEQ ID NO: 2931 - DNA, 54 bp; single-stranded, linear
cacuugaaagaaguaagaaccagagaaacacacguugugguacauuaccuggua

SEQ ID NO: 2932 - DNA, 54 bp; single-stranded, linear
uucuggaaagaaggaacuaccagagaaacacacguugugguacauuaccuggua

SEQ ID NO: 2933 - DNA, 54 bp; single-stranded, linear
cucacauaagaaggguucaccagagaaacacacguugugguacauuaccuggua

SEQ ID NO: 2934 - DNA, 54 bp; single-stranded, linear
ccucaggcagaagcaaaaaccagagaaacacacguugugguacauuaccuggua

SEQ ID NO: 2935 - DNA, 54 bp; single-stranded, linear
ccagcaugagaagauagaaccagagaaacacacguugugguacauuaccuggua

SEQ ID NO: 2936 - DNA, 54 bp; single-stranded, linear
ucugugccagaaguccagaccagagaaacacacguugugguacauuaccuggua

SEQ ID NO: 2937 - DNA, 54 bp; single-stranded, linear
ucagagaaagaaggaguuaccagagaaacacacguugugguacauuaccuggua

SEQ ID NO: 2938 - DNA, 54 bp; single-stranded, linear
aacuucggagaagaaauaaccagagaaacacacguugugguacauuaccuggua

SEQ ID NO: 2939 - DNA, 54 bp; single-stranded, linear
cugacaucagaagagcuuaccagagaaacacacguugugguacauuaccuggua

SEQ ID NO: 2940 - DNA, 54 bp; single-stranded, linear
gagaggccagaagagugcaccagagaaacacacguugugguacauuaccuggua

SEQ ID NO: 2941 - DNA, 54 bp; single-stranded, linear
ugacaucaagaagccccgaccagagaaacacacguugugguacauuaccuggua

SEQ ID NO: 2942 - DNA, 54 bp; single-stranded, linear
cugcugacagaagacagcaccagagaaacacacguugugguacauuaccuggua

SEQ ID NO: 2943 - DNA, 54 bp; single-stranded, linear
auggcagaagaagggccuaccagagaaacacacguugugguacauuaccuggua

SEQ ID NO: 2944 - DNA, 54 bp; single-stranded, linear
gugcccacagaaggaaugaccagagaaacacacguugugguacauuaccuggua

SEQ ID NO: 2945 - DNA, 54 bp; single-stranded, linear
gggcggggagaagcacgcaccagagaaacacacguugugguacauuaccuggua

SEQ ID NO: 2946 - DNA, 54 bp; single-stranded, linear
agucugggagaagggagcaccagagaaacacacguugugguacauuaccuggua

SEQ ID NO: 2947 - DNA, 54 bp; single-stranded, linear
gaguuguaagaagggggcaccagagaaacacacguugugguacauuaccuggua

SEQ ID NO: 2948 - DNA, 54 bp; single-stranded, linear
caaaaagcagaaggcuccaccagagaaacacacguugugguacauuaccuggua

SEQ ID NO: 2949 - DNA, 54 bp; single-stranded, linear
ucacaaaaagaagcuggcaccagagaaacacacguugugguacauuaccuggua

SEQ ID NO: 2950 - DNA, 54 bp; single-stranded, linear
gggguuggagaagggaagaccagagaaacacacguugugguacauuaccuggua

SEQ ID NO: 2951 - DNA, 54 bp; single-stranded, linear
cucaaucaagaagguccuaccagagaaacacacguugugguacauuaccuggua

SEQ ID NO: 2952 - DNA, 54 bp; single-stranded, linear
auugggugagaagugcagaccagagaaacacacguugugguacauuaccuggua

SEQ ID NO: 2953 - DNA, 54 bp; single-stranded, linear
ggcugcagagaaggcccaaccagagaaacacacguugugguacauuaccuggua

SEQ ID NO: 2954 - DNA, 54 bp; single-stranded, linear
ggguuuugagaagcagggaccagagaaacacacguugugguacauuaccuggua

SEQ ID NO: 2955 - DNA, 54 bp; single-stranded, linear
agggucagagaagggaagaccagagaaacacacguugugguacauuaccuggua

SEQ ID NO: 2956 - DNA, 54 bp; single-stranded, linear
guagaaggagaagagcugaccagagaaacacacguugugguacauuaccuggua

SEQ ID NO: 2957 - DNA, 54 bp; single-stranded, linear
cgcuguccagaagcuccuaccagagaaacacacguugugguacauuaccuggua

SEQ ID NO: 2958 - DNA, 54 bp; single-stranded, linear
cugugcaaagaagaauaaaccagagaaacacacguugugguacauuaccuggua

SEQ ID NO: 2959 - DNA, 54 bp; single-stranded, linear
cuccucagagaagcauuuaccagagaaacacacguugugguacauuaccuggua

SEQ ID NO: 2960 - DNA, 54 bp; single-stranded, linear
uuuccuccagaagcccucaccagagaaacacacguugugguacauuaccuggua

SEQ ID NO: 2961 - DNA, 54 bp; single-stranded, linear
gguauagaagaagggucuaccagagaaacacacguugugguacauuaccuggua

SEQ ID NO: 2962 - DNA, 54 bp; single-stranded, linear
ugggucccagaaguguugaccagagaaacacacguugugguacauuaccuggua

SEQ ID NO: 2963 - DNA, 54 bp; single-stranded, linear
ugagucccagaaggagaaaccagagaaacacacguugugguacauuaccuggua

SEQ ID NO: 2964 - DNA, 54 bp; single-stranded, linear
aguuucaaagaaguugaaaccagagaaacacacguugugguacauuaccuggua

SEQ ID NO: 2965 - DNA, 54 bp; single-stranded, linear
uagcaucaagaagagccaaccagagaaacacacguugugguacauuaccuggua

SEQ ID NO: 2966 - DNA, 54 bp; single-stranded, linear; identical to SEQ ID NO: 2965

SEQ ID NO: 2967 - DNA, 54 bp; single-stranded, linear
ccccaagaagaagcaaucaccagagaaacacacguugugguacauuaccuggua

SEQ ID NO: 2968 - DNA, 54 bp; single-stranded, linear
cacauaagagaagaggcaaccagagaaacacacguugugguacauuaccuggua

SEQ ID NO: 2969 - DNA, 54 bp; single-stranded, linear
uccacaaaagaagcugccaccagagaaacacacguugugguacauuaccuggua

SEQ ID NO: 2970 - DNA, 54 bp; single-stranded, linear
guggagagagaagucccaaccagagaaacacacguugugguacauuaccuggua

SEQ ID NO: 2971 - DNA, 54 bp; single-stranded, linear
aaauugccagaagucacaaccagagaaacacacguugugguacauuaccuggua

SEQ ID NO: 2972 - DNA, 54 bp; single-stranded, linear
aagacaugagaagcuaagaccagagaaacacacguugugguacauuaccuggua

SEQ ID NO: 2973 - DNA, 54 bp; single-stranded, linear
uuugaaggagaagaguaaaccagagaaacacacguugugguacauuaccuggua

SEQ ID NO: 2974 - DNA, 54 bp; single-stranded, linear
uccacccaagaaguuccaaccagagaaacacacguugugguacauuaccuggua

SEQ ID NO: 2975 - DNA, 54 bp; single-stranded, linear
acuucuugagaagacaagaccagagaaacacacguugugguacauuaccuggua

SEQ ID NO: 2976 - DNA, 54 bp; single-stranded, linear
aacauaaaagaaguugccaccagagaaacacacguugugguacauuaccuggua

SEQ ID NO: 2977 - DNA, 54 bp; single-stranded, linear
uggaaggaagaagaacauaccagagaaacacacguugugguacauuaccuggua

SEQ ID NO: 2978 - DNA, 54 bp; single-stranded, linear
cccauacaagaagcuaaaaccagagaaacacacguugugguacauuaccuggua

SEQ ID NO: 2979 - DNA, 54 bp; single-stranded, linear
uuuucaugagaaggaauuaccagagaaacacacguugugguacauuaccuggua

SEQ ID NO: 2980 - DNA, 54 bp; single-stranded, linear
gacauucaagaagaaaugaccagagaaacacacguugugguacauuaccuggua

SEQ ID NO: 2981 - DNA, 54 bp; single-stranded, linear
aauauauaagaagacauuaccagagaaacacacguugugguacauuaccuggua

SEQ ID NO: 2982 - DNA, 54 bp; single-stranded, linear
auacaaagagaagagaauaccagagaaacacacguugugguacauuaccuggua

SEQ ID NO: 2983 - DNA, 18 bp; single-stranded, linear
ccucucggcuccuccccg

SEQ ID NO: 2984 - DNA, 18 bp; single-stranded, linear
ggcggcggcucggagcgg

SEQ ID NO: 2985 - DNA, 18 bp; single-stranded, linear
gaggacggacucuggcgg

SEQ ID NO: 2986 - DNA, 18 bp; single-stranded, linear
ucuggcggccgggucguu

SEQ ID NO: 2987 - DNA, 18 bp; single-stranded, linear
ggguccugcugugcgcgc

SEQ ID NO: 2988 - DNA, 18 bp; single-stranded, linear
gcgcgcugcucagcuguc

SEQ ID NO: 2989 - DNA, 18 bp; single-stranded, linear
cugcucagcugucugcuu

SEQ ID NO: 2990 - DNA, 18 bp; single-stranded, linear
cucagcugucugcuucuc

SEQ ID NO: 2991 - DNA, 18 bp; single-stranded, linear
gcugucugcuucucacag

SEQ ID NO: 2992 - DNA, 18 bp; single-stranded, linear
ggaagcagcccauaaaug

SEQ ID NO: 2993 - DNA, 18 bp; single-stranded, linear
uaaaucugccuguggaag

SEQ ID NO: 2994 - DNA, 18 bp; single-stranded, linear
gaacacagcucaagcaaa

SEQ ID NO: 2995 - DNA, 18 bp; single-stranded, linear
uucuacagcugcaaauau

SEQ ID NO: 2996 - DNA, 18 bp; single-stranded, linear
auucccugccggguuacg

SEQ ID NO: 2997 - DNA, 18 bp; single-stranded, linear
gaucccugauggaaaacg

SEQ ID NO: 2998 - DNA, 18 bp; single-stranded, linear
ggcuucugaccugugaag

SEQ ID NO: 2999 - DNA, 18 bp; single-stranded, linear
uuacccugaugaaaaaaa

SEQ ID NO: 3000 - DNA, 18 bp; single-stranded, linear
gcaagcggucuuaccggc

SEQ ID NO: 3001 - DNA, 18 bp; single-stranded, linear
cuuaccggcucucuauga

SEQ ID NO: 3002 - DNA, 18 bp; single-stranded, linear
gaaaucugcucgcuauuu

SEQ ID NO: 3003 - DNA, 18 bp; single-stranded, linear
aaccccagauuuacgaaa

SEQ ID NO: 3004 - DNA, 18 bp; single-stranded, linear
guuuccagacccggcucu

SEQ ID NO: 3005 - DNA, 18 bp; single-stranded, linear
agacccggcucucuaccc

SEQ ID NO: 3006 - DNA, 18 bp; single-stranded, linear
aaauccugacuuguaccg

SEQ ID NO: 3007 - DNA, 18 bp; single-stranded, linear
uguggcugacucuagaau

SEQ ID NO: 3008 - DNA, 18 bp; single-stranded, linear
uaucacagaugugccaaa

SEQ ID NO: 3009 - DNA, 18 bp; single-stranded, linear
aaaugccgacggaaggag

SEQ ID NO: 3010 - DNA, 18 bp; single-stranded, linear
ugaaacugucuugcacag

SEQ ID NO: 3011 - DNA, 18 bp; single-stranded, linear
aucagcaguuccaccacu

SEQ ID NO: 3012 - DNA, 18 bp; single-stranded, linear
agccucagaucacuuggu

SEQ ID NO: 3013 - DNA, 18 bp; single-stranded, linear
gcacgcuguuuauugaaa

SEQ ID NO: 3014 - DNA, 18 bp; single-stranded, linear
ccucacuguucaaggaac

SEQ ID NO: 3015 - DNA, 18 bp; single-stranded, linear
uggagcugaucacucuaa

SEQ ID NO: 3016 - DNA, 18 bp; single-stranded, linear
aaagacugacuaccuauc

SEQ ID NO: 3017 - DNA, 18 bp; single-stranded, linear
ggacccagaugaaguucc

SEQ ID NO: 3018 - DNA, 18 bp; single-stranded, linear
gugagcggcucccuuaug

SEQ ID NO: 3019 - DNA, 18 bp; single-stranded, linear
cgugccggacuguggcug

SEQ ID NO: 3020 - DNA, 18 bp; single-stranded, linear
aagcucugaugacugagc

SEQ ID NO: 3021 - DNA, 18 bp; single-stranded, linear
uuaaccugcugggagccu

SEQ ID NO: 3022 - DNA, 18 bp; single-stranded, linear
ggccucugauggugauug

SEQ ID NO: 3023 - DNA, 18 bp; single-stranded, linear
agcuccggcuuucaggaa

SEQ ID NO: 3024 - DNA, 18 bp; single-stranded, linear
ggauucugacgguuucua

SEQ ID NO: 3025 - DNA, 18 bp; single-stranded, linear
ucugacgguuucuacaag

SEQ ID NO: 3026 - DNA, 18 bp; single-stranded, linear
aagaucugauuucuuaca

SEQ ID NO: 3027 - DNA, 18 bp; single-stranded, linear
ucuuacaguuuucaagug

SEQ ID NO: 3028 - DNA, 18 bp; single-stranded, linear
aguuccugucuuccagaa

SEQ ID NO: 3029 - DNA, 18 bp; single-stranded, linear
gaaccccgauuaugugag

SEQ ID NO: 3030 - DNA, 18 bp; single-stranded, linear
uuuugcagucgccugagg

SEQ ID NO: 3031 - DNA, 18 bp; single-stranded, linear
ucuaucagaucaugcugg

SEQ ID NO: 3032 - DNA, 18 bp; single-stranded, linear
cuggacugcuggcacaga

SEQ ID NO: 3033 - DNA, 18 bp; single-stranded, linear
aacuccugccuucucuga

SEQ ID NO: 3034 - DNA, 18 bp; single-stranded, linear
uauuucagcuccgaaguu

SEQ ID NO: 3035 - DNA, 18 bp; single-stranded, linear
aagcucugaugaugucag

SEQ ID NO: 3036 - DNA, 18 bp; single-stranded, linear
gcacucuguuggccucuc

SEQ ID NO: 3037 - DNA, 18 bp; single-stranded, linear
cggggcugucugauguca

SEQ ID NO: 3038 - DNA, 18 bp; single-stranded, linear
gcugucugaugucagcag

SEQ ID NO: 3039 - DNA, 18 bp; single-stranded, linear
aggcccaguuucugccau

SEQ ID NO: 3040 - DNA, 18 bp; single-stranded, linear
cauuccagcugugggcac

SEQ ID NO: 3041 - DNA, 18 bp; single-stranded, linear
gcgugcugcuccccgccc

SEQ ID NO: 3042 - DNA, 18 bp; single-stranded, linear
gcuccccgcccccagacu

SEQ ID NO: 3043 - DNA, 18 bp; single-stranded, linear
gcccccagacuacaacuc

SEQ ID NO: 3044 - DNA, 18 bp; single-stranded, linear
ggagccagcugcuuuuug

SEQ ID NO: 3045 - DNA, 18 bp; single-stranded, linear
gccagcugcuuuuuguga

SEQ ID NO: 3046 - DNA, 18 bp; single-stranded, linear
cuucccugcuccaacccc

SEQ ID NO: 3047 - DNA, 18 bp; single-stranded, linear
aggaccaguuugauugag

SEQ ID NO: 3048 - DNA, 18 bp; single-stranded, linear
cugcacugaucacccaau

SEQ ID NO: 3049 - DNA, 18 bp; single-stranded, linear
ugggccagcccugcagcc

SEQ ID NO: 3050 - DNA, 18 bp; single-stranded, linear
cccugcagcccaaaaccc

SEQ ID NO: 3051 - DNA, 18 bp; single-stranded, linear
cuucccagcucugacccu

SEQ ID NO: 3052 - DNA, 18 bp; single-stranded, linear
cagcucugacccuucuac

SEQ ID NO: 3053 - DNA, 18 bp; single-stranded, linear
aggagcagauggacagcg

SEQ ID NO: 3054 - DNA, 18 bp; single-stranded, linear
uuauucuguuuugcacag

SEQ ID NO: 3055 - DNA, 18 bp; single-stranded, linear
aaaugcaguccugaggag

SEQ ID NO: 3056 - DNA, 18 bp; single-stranded, linear
gagggcugauggaggaaa

SEQ ID NO: 3057 - DNA, 18 bp; single-stranded, linear
agaccccgucucuauacc

SEQ ID NO: 3058 - DNA, 18 bp; single-stranded, linear
caacacaguugggaccca

SEQ ID NO: 3059 - DNA, 18 bp; single-stranded, linear
uucuccaguugggacuca

SEQ ID NO: 3060 - DNA, 18 bp; single-stranded, linear
uucaacugcuuugaaacu

SEQ ID NO: 3061 - DNA, 18 bp; single-stranded, linear
uggcucuguuugaugcua

SEQ ID NO: 3062 - DNA, 18 bp; single-stranded, linear
uggcucuguuugaugcua

SEQ ID NO: 3063 - DNA, 18 bp; single-stranded, linear
gauugcugcuucuugggg

SEQ ID NO: 3064 - DNA, 18 bp; single-stranded, linear
ugccucuguucuuaugug

SEQ ID NO: 3065 - DNA, 18 bp; single-stranded, linear
ggcagcggcuuuugugga

SEQ ID NO: 3066 - DNA, 18 bp; single-stranded, linear
ugggacaguccucuccac

SEQ ID NO: 3067 - DNA, 18 bp; single-stranded, linear
ugugacagcuggcaauuu

SEQ ID NO: 3068 - DNA, 18 bp; single-stranded, linear
cuuagcuguucaugucuu

SEQ ID NO: 3069 - DNA, 18 bp; single-stranded, linear
uuacucagcuccuucaaa

SEQ ID NO: 3070 - DNA, 18 bp; single-stranded, linear
uggaacagucugggugga

SEQ ID NO: 3071 - DNA, 18 bp; single-stranded, linear
cuugucaguccaagaagu

SEQ ID NO: 3072 - DNA, 18 bp; single-stranded, linear
ggcaacugcuuuuauguu

SEQ ID NO: 3073 - DNA, 18 bp; single-stranded, linear
auguucugucuccuucca

SEQ ID NO: 3074 - DNA, 18 bp; single-stranded, linear
uuuagcugauuguauggg

SEQ ID NO: 3075 - DNA, 18 bp; single-stranded, linear
aauuccuguccaugaaaa

SEQ ID NO: 3076 - DNA, 18 bp; single-stranded, linear
cauuucagccugaauguc

SEQ ID NO: 3077 - DNA, 18 bp; single-stranded, linear
aaugucugccuauauauu

SEQ ID NO: 3078 - DNA, 18 bp; single-stranded, linear
auucucugcucuuuguau

SEQ ID NO: 3079 - DNA, 27 bp; single-stranded, linear
  The letter "N" represents the stem II region of an HH ribozyme.
cacagggccugaugangaaacggccag

SEQ ID NO: 3080 - DNA, 27 bp; single-stranded, linear
  The letter "N" represents the stem II region of an HH ribozyme.
uccacgcacugaugangaaagccacag

SEQ ID NO: 3081 - DNA, 27 bp; single-stranded, linear
  The letter "N" represents the stem II region of an HH ribozyme.
aacccacacugaugangaaaggcggcc

SEQ ID NO: 3082 - DNA, 27 bp; single-stranded, linear
  The letter "N" represents the stem II region of an HH ribozyme.
acuaggcacugaugangaaacccacag

SEQ ID NO: 3083 - DNA, 27 bp; single-stranded, linear
  The letter "N" represents the stem II region of an HH ribozyme.
cacuaggccugaugangaaaacccaca

SEQ ID NO: 3084 - DNA, 27 bp; single-stranded, linear
  The letter "N" represents the stem II region of an HH ribozyme.
agaaacaccugaugangaaaggcaaac

SEQ ID NO: 3085 - DNA, 27 bp; single-stranded, linear
  The letter "N" represents the stem II region of an HH ribozyme.
ucaagagacugaugangaaacacuagg

SEQ ID NO: 3086 - DNA, 27 bp; single-stranded, linear
  The letter "N" represents the stem II region of an HH ribozyme.
aucaagagcugaugangaaaacacuag

SEQ ID NO: 3087 - DNA, 27 bp; single-stranded, linear
  The letter "N" represents the stem II region of an HH ribozyme.
gaucaagacugaugangaaaaacacua

SEQ ID NO: 3088 - DNA, 27 bp; single-stranded, linear
  The letter "N" represents the stem II region of an HH ribozyme.
cagaucaacugaugangaaagaaacac

SEQ ID NO: 3089 - DNA, 27 bp; single-stranded, linear
  The letter "N" represents the stem II region of an HH ribozyme.
ggcagauccugaugangaaagagaaac

SEQ ID NO: 3090 - DNA, 27 bp; single-stranded, linear
  The letter "N" represents the stem II region of an HH ribozyme.
ccugggcacugaugangaaaucaagag

SEQ ID NO: 3091 - DNA, 27 bp; single-stranded, linear
  The letter "N" represents the stem II region of an HH ribozyme.
uguaugcucugaugangaaagccuggg

SEQ ID NO: 3092 - DNA, 27 bp; single-stranded, linear
  The letter "N" represents the stem II region of an HH ribozyme.
ucuuuuugcugaugangaaaugcugag

SEQ ID NO: 3093 - DNA, 27 bp; single-stranded, linear
  The letter "N" represents the stem II region of an HH ribozyme.
auuguaagcugaugangaaaugucuuu

SEQ ID NO: 3094 - DNA, 27 bp; single-stranded, linear
  The letter "N" represents the stem II region of an HH ribozyme.
uuaauugucugaugangaaaguauguc

SEQ ID NO: 3095 - DNA, 27 bp; single-stranded, linear
  The letter "N" represents the stem II region of an HH ribozyme.
cuuaauugcugaugangaaaaguaugu

SEQ ID NO: 3096 - DNA, 27 bp; single-stranded, linear
  The letter "N" represents the stem II region of an HH ribozyme.
uuagccuucugaugangaaauuguaag

SEQ ID NO: 3097 - DNA, 27 bp; single-stranded, linear
  The letter "N" represents the stem II region of an HH ribozyme.
auuagccucugaugangaaaauuguaa

SEQ ID NO: 3098 - DNA, 27 bp; single-stranded, linear
  The letter "N" represents the stem II region of an HH ribozyme.
aguuguaucugaugangaaagccuuaa

SEQ ID NO: 3099 - DNA, 27 bp; single-stranded, linear
  The letter "N" represents the stem II region of an HH ribozyme.
aagaguugcugaugangaaauuagccu

SEQ ID NO: 3100 - DNA, 27 bp; single-stranded, linear
  The letter "N" represents the stem II region of an HH ribozyme.
aauuugaacugaugangaaaguuguau

SEQ ID NO: 3101 - DNA, 27 bp; single-stranded, linear
  The letter "N" represents the stem II region of an HH ribozyme.
guaauuugcugaugangaaagaguugu

SEQ ID NO: 3102 - DNA, 27 bp; single-stranded, linear
  The letter "N" represents the stem II region of an HH ribozyme.
aguaauuucugaugangaaaagaguug

SEQ ID NO: 3103 - DNA, 27 bp; single-stranded, linear
  The letter "N" represents the stem II region of an HH ribozyme.
cugcaagucugaugangaaauuugaag

SEQ ID NO: 3104 - DNA, 27 bp; single-stranded, linear
  The letter "N" represents the stem II region of an HH ribozyme.
ccugcaagcugaugangaaaauuugaa

SEQ ID NO: 3105 - DNA, 27 bp; single-stranded, linear
  The letter "N" represents the stem II region of an HH ribozyme.
uccccugccugaugangaaaguaauuu

SEQ ID NO: 3106 - DNA, 27 bp; single-stranded, linear
  The letter "N" represents the stem II region of an HH ribozyme.
gccagucccugaugangaaagucccuc

SEQ ID NO: 3107 - DNA, 27 bp; single-stranded, linear
  The letter "N" represents the stem II region of an HH ribozyme.
uugggccacugaugangaaagccaguc

SEQ ID NO: 3108 - DNA, 27 bp; single-stranded, linear
  The letter "N" represents the stem II region of an HH ribozyme.
auugggcccugaugangaaaagccagu

SEQ ID NO: 3109 - DNA, 27 bp; single-stranded, linear
  The letter "N" represents the stem II region of an HH ribozyme.
acucugaucugaugangaaauugggcc

SEQ ID NO: 3110 - DNA, 27 bp; single-stranded, linear
  The letter "N" represents the stem II region of an HH ribozyme.
gccacucucugaugangaaauuauugg

SEQ ID NO: 3111 - DNA, 27 bp; single-stranded, linear
  The letter "N" represents the stem II region of an HH ribozyme.
uuacagaacugaugangaaaggccauc

SEQ ID NO: 3112 - DNA, 27 bp; single-stranded, linear
  The letter "N" represents the stem II region of an HH ribozyme.
ucuuacagcugaugangaaagaggcca

SEQ ID NO: 3113 - DNA, 27 bp; single-stranded, linear
  The letter "N" represents the stem II region of an HH ribozyme.
gucuuacacugaugangaaaagaggcc

SEQ ID NO: 3114 - DNA, 27 bp; single-stranded, linear
  The letter "N" represents the stem II region of an HH ribozyme.
gagugucucugaugangaaacagaaga

SEQ ID NO: 3115 - DNA, 27 bp; single-stranded, linear
  The letter "N" represents the stem II region of an HH ribozyme.
ggaauugucugaugangaaagugucuu

SEQ ID NO: 3116 - DNA, 27 bp; single-stranded, linear
  The letter "N" represents the stem II region of an HH ribozyme.
acuuuuggcugaugangaaauugugag

SEQ ID NO: 3117 - DNA, 27 bp; single-stranded, linear
  The letter "N" represents the stem II region of an HH ribozyme.
cacuuuugcugaugangaaaauuguga

SEQ ID NO: 3118 - DNA, 27 bp; single-stranded, linear
  The letter "N" represents the stem II region of an HH ribozyme.
ucauuucccugaugangaaaucacuuu

SEQ ID NO: 3119 - DNA, 27 bp; single-stranded, linear
  The letter "N" represents the stem II region of an HH ribozyme.
agcacuugcugaugangaaaggcucca

SEQ ID NO: 3120 - DNA, 27 bp; single-stranded, linear
  The letter "N" represents the stem II region of an HH ribozyme.
cccgguagcugaugangaaagcacuug

SEQ ID NO: 3121 - DNA, 27 bp; single-stranded, linear
  The letter "N" represents the stem II region of an HH ribozyme.
ucccgguacugaugangaaaagcacuu

SEQ ID NO: 3122 - DNA, 27 bp; single-stranded, linear
  The letter "N" represents the stem II region of an HH ribozyme.
uuucccggcugaugangaaagaagcac

SEQ ID NO: 3123 - DNA, 27 bp; single-stranded, linear
  The letter "N" represents the stem II region of an HH ribozyme.
ccgaggcccugaugangaaagucaguu

SEQ ID NO: 3124 - DNA, 27 bp; single-stranded, linear
  The letter "N" represents the stem II region of an HH ribozyme.
aaaugacccugaugangaaaggccaag

SEQ ID NO: 3125 - DNA, 27 bp; single-stranded, linear
  The letter "N" represents the stem II region of an HH ribozyme.
acauaaaucugaugangaaaccgaggc

SEQ ID NO: 3126 - DNA, 27 bp; single-stranded, linear
  The letter "N" represents the stem II region of an HH ribozyme.
uagacauacugaugangaaaugaccga

SEQ ID NO: 3127 - DNA, 27 bp; single-stranded, linear
  The letter "N" represents the stem II region of an HH ribozyme.
auagacaucugaugangaaaaugaccg

SEQ ID NO: 3128 - DNA, 27 bp; single-stranded, linear
  The letter "N" represents the stem II region of an HH ribozyme.
cauagacacugaugangaaaaaugacc

SEQ ID NO: 3129 - DNA, 27 bp; single-stranded, linear
  The letter "N" represents the stem II region of an HH ribozyme.
ugaacauacugaugangaaacauaaau

SEQ ID NO: 3130 - DNA, 27 bp; single-stranded, linear
  The letter "N" represents the stem II region of an HH ribozyme.
cuugaacacugaugangaaagacauaa

SEQ ID NO: 3131 - DNA, 27 bp; single-stranded, linear
  The letter "N" represents the stem II region of an HH ribozyme.
uaaucuugcugaugangaaacauagac

SEQ ID NO: 3132 - DNA, 27 bp; single-stranded, linear
  The letter "N" represents the stem II region of an HH ribozyme.
guaaucuucugaugangaaaacauaga

SEQ ID NO: 3133 - DNA, 27 bp; single-stranded, linear
  The letter "N" represents the stem II region of an HH ribozyme.
agaucugucugaugangaaaucuugaa

SEQ ID NO: 3134 - DNA, 27 bp; single-stranded, linear
  The letter "N" represents the stem II region of an HH ribozyme.
gagaucugcugaugangaaaaucuuga

SEQ ID NO: 3135 - DNA, 27 bp; single-stranded, linear
  The letter "N" represents the stem II region of an HH ribozyme.
uaaauggacugaugangaaaucuguaa

SEQ ID NO: 3136 - DNA, 27 bp; single-stranded, linear
  The letter "N" represents the stem II region of an HH ribozyme.
aauaaaugcugaugangaaagaucugu

SEQ ID NO: 3137 - DNA, 27 bp; single-stranded, linear
  The letter "N" represents the stem II region of an HH ribozyme.
aagcaauacugaugangaaauggagau

SEQ ID NO: 3138 - DNA, 27 bp; single-stranded, linear
  The letter "N" represents the stem II region of an HH ribozyme.
gaagcaaucugaugangaaaauggaga

SEQ ID NO: 3139 - DNA, 27 bp; single-stranded, linear
  The letter "N" represents the stem II region of an HH ribozyme.
agaagcaacugaugangaaaaauggag

SEQ ID NO: 3140 - DNA, 27 bp; single-stranded, linear
  The letter "N" represents the stem II region of an HH ribozyme.
acagaagccugaugangaaauaaaugg

SEQ ID NO: 3141 - DNA, 27 bp; single-stranded, linear
  The letter "N" represents the stem II region of an HH ribozyme.
acuaacagcugaugangaaagcaauaa

SEQ ID NO: 3142 - DNA, 27 bp; single-stranded, linear
  The letter "N" represents the stem II region of an HH ribozyme.
cacuaacacugaugangaaaagcaaua

SEQ ID NO: 3143 - DNA, 27 bp; single-stranded, linear
  The letter "N" represents the stem II region of an HH ribozyme.
uggucacucugaugangaaacagaagc

SEQ ID NO: 3144 - DNA, 27 bp; single-stranded, linear
  The letter "N" represents the stem II region of an HH ribozyme.
uuggucaccugaugangaaaacagaag

SEQ ID NO: 3145 - DNA, 27 bp; single-stranded, linear
  The letter "N" represents the stem II region of an HH ribozyme.
auguacaccugaugangaaacuccaug

SEQ ID NO: 3146 - DNA, 27 bp; single-stranded, linear
  The letter "N" represents the stem II region of an HH ribozyme.
caguaaugcugaugangaaacacgacu

SEQ ID NO: 3147 - DNA, 27 bp; single-stranded, linear
  The letter "N" represents the stem II region of an HH ribozyme.
uucucagucugaugangaaauguacac

SEQ ID NO: 3148 - DNA, 27 bp; single-stranded, linear
  The letter "N" represents the stem II region of an HH ribozyme.
guucucagcugaugangaaaauguaca

SEQ ID NO: 3149 - DNA, 27 bp; single-stranded, linear
  The letter "N" represents the stem II region of an HH ribozyme.
agacauggcugaugangaaaucaccac

SEQ ID NO: 3150 - DNA, 27 bp; single-stranded, linear
  The letter "N" represents the stem II region of an HH ribozyme.
gagacaugcugaugangaaaaucacca

SEQ ID NO: 3151 - DNA, 27 bp; single-stranded, linear
  The letter "N" represents the stem II region of an HH ribozyme.
ggacccgacugaugangaaacauggaa

SEQ ID NO: 3152 - DNA, 27 bp; single-stranded, linear
  The letter "N" represents the stem II region of an HH ribozyme.
auggaccccugaugangaaagacaugg

SEQ ID NO: 3153 - DNA, 27 bp; single-stranded, linear
  The letter "N" represents the stem II region of an HH ribozyme.
uugaaaugcugaugangaaacccgaga

SEQ ID NO: 3154 - DNA, 27 bp; single-stranded, linear
  The letter "N" represents the stem II region of an HH ribozyme.
agauuugacugaugangaaauggaccc

SEQ ID NO: 3155 - DNA, 27 bp; single-stranded, linear
  The letter "N" represents the stem II region of an HH ribozyme.
gagauuugcugaugangaaaauggacc

SEQ ID NO: 3156 - DNA, 27 bp; single-stranded, linear
  The letter "N" represents the stem II region of an HH ribozyme.
ugagauuucugaugangaaaaauggac

SEQ ID NO: 3157 - DNA, 27 bp; single-stranded, linear
  The letter "N" represents the stem II region of an HH ribozyme.
cacguugacugaugangaaauuugaaa

SEQ ID NO: 3158 - DNA, 27 bp; single-stranded, linear
  The letter "N" represents the stem II region of an HH ribozyme.
gacacguucugaugangaaagauuuga

SEQ ID NO: 3159 - DNA, 27 bp; single-stranded, linear
  The letter "N" represents the stem II region of an HH ribozyme.
cacaaagucugaugangaaacacguug

SEQ ID NO: 3160 - DNA, 27 bp; single-stranded, linear
  The letter "N" represents the stem II region of an HH ribozyme.
cuugcacacugaugangaaagugacac

SEQ ID NO: 3161 - DNA, 27 bp; single-stranded, linear
  The letter "N" represents the stem II region of an HH ribozyme.
ucuugcaccugaugangaaaagugaca

SEQ ID NO: 3162 - DNA, 27 bp; single-stranded, linear
  The letter "N" represents the stem II region of an HH ribozyme.
uuucugggcugaugangaaaucuugca

SEQ ID NO: 3163 - DNA, 27 bp; single-stranded, linear
  The letter "N" represents the stem II region of an HH ribozyme.
caggaacacugaugangaaaucucuuu

SEQ ID NO: 3164 - DNA, 27 bp; single-stranded, linear
  The letter "N" represents the stem II region of an HH ribozyme.
ucaggaaccugaugangaaaaucucuu

SEQ ID NO: 3165 - DNA, 27 bp; single-stranded, linear
  The letter "N" represents the stem II region of an HH ribozyme.
ccaucaggcugaugangaaacaaaucu

SEQ ID NO: 3166 - DNA, 27 bp; single-stranded, linear
  The letter "N" represents the stem II region of an HH ribozyme.
accaucagcugaugangaaaacaaauc

SEQ ID NO: 3167 - DNA, 27 bp; single-stranded, linear
  The letter "N" represents the stem II region of an HH ribozyme.
aauucugucugaugangaaaccaucag

SEQ ID NO: 3168 - DNA, 27 bp; single-stranded, linear
  The letter "N" represents the stem II region of an HH ribozyme.
ucccaggacugaugangaaauucuguu

SEQ ID NO: 3169 - DNA, 27 bp; single-stranded, linear
  The letter "N" represents the stem II region of an HH ribozyme.
gucccaggcugaugangaaaauucugu

SEQ ID NO: 3170 - DNA, 27 bp; single-stranded, linear
  The letter "N" represents the stem II region of an HH ribozyme.
ugucccagcugaugangaaaaauucug

SEQ ID NO: 3171 - DNA, 27 bp; single-stranded, linear
  The letter "N" represents the stem II region of an HH ribozyme.
gaauaguacugaugangaaagcccuuc

SEQ ID NO: 3172 - DNA, 27 bp; single-stranded, linear
  The letter "N" represents the stem II region of an HH ribozyme.
ggaauagucugaugangaaaagcccuu

SEQ ID NO: 3173 - DNA, 27 bp; single-stranded, linear
  The letter "N" represents the stem II region of an HH ribozyme.
gggaauagcugaugangaaaaagcccu

SEQ ID NO: 3174 - DNA, 27 bp; single-stranded, linear
  The letter "N" represents the stem II region of an HH ribozyme.
gcugggaacugaugangaaaguaaagc

SEQ ID NO: 3175 - DNA, 27 bp; single-stranded, linear
  The letter "N" represents the stem II region of an HH ribozyme.
uagcugggcugaugangaaauaguaaa

SEQ ID NO: 3176 - DNA, 27 bp; single-stranded, linear
  The letter "N" represents the stem II region of an HH ribozyme.
guagcuggcugaugangaaaauaguaa

SEQ ID NO: 3177 - DNA, 27 bp; single-stranded, linear
  The letter "N" represents the stem II region of an HH ribozyme.
ugaucaugcugaugangaaagcuggga

SEQ ID NO: 3178 - DNA, 27 bp; single-stranded, linear
  The letter "N" represents the stem II region of an HH ribozyme.
gcauagcucugaugangaaaucaugua

SEQ ID NO: 3179 - DNA, 27 bp; single-stranded, linear
  The letter "N" represents the stem II region of an HH ribozyme.
ugccagcacugaugangaaagcugauc

SEQ ID NO: 3180 - DNA, 27 bp; single-stranded, linear
  The letter "N" represents the stem II region of an HH ribozyme.
ucacagaacugaugangaaaccaugcc

SEQ ID NO: 3181 - DNA, 27 bp; single-stranded, linear
  The letter "N" represents the stem II region of an HH ribozyme.
cuucacagcugaugangaaagaccaug

SEQ ID NO: 3182 - DNA, 27 bp; single-stranded, linear
  The letter "N" represents the stem II region of an HH ribozyme.
gcuucacacugaugangaaaagaccau

SEQ ID NO: 3183 - DNA, 27 bp; single-stranded, linear
  The letter "N" represents the stem II region of an HH ribozyme.
ucaucauucugaugangaaauuuuugc

SEQ ID NO: 3184 - DNA, 27 bp; single-stranded, linear
  The letter "N" represents the stem II region of an HH ribozyme.
uucaucaucugaugangaaaauuuuug

SEQ ID NO: 3185 - DNA, 27 bp; single-stranded, linear
  The letter "N" represents the stem II region of an HH ribozyme.
agacuggucugaugangaaacuuucau

SEQ ID NO: 3186 - DNA, 27 bp; single-stranded, linear
  The letter "N" represents the stem II region of an HH ribozyme.
uagacuggcugaugangaaaacuuuca

SEQ ID NO: 3187 - DNA, 27 bp; single-stranded, linear
  The letter "N" represents the stem II region of an HH ribozyme.
acauaauacugaugangaaacugguaa

SEQ ID NO: 3188 - DNA, 27 bp; single-stranded, linear
  The letter "N" represents the stem II region of an HH ribozyme.
guacauaacugaugangaaagacuggu

SEQ ID NO: 3189 - DNA, 27 bp; single-stranded, linear
  The letter "N" represents the stem II region of an HH ribozyme.
auguacaucugaugangaaauagacug

SEQ ID NO: 3190 - DNA, 27 bp; single-stranded, linear
  The letter "N" represents the stem II region of an HH ribozyme.
uauguacacugaugangaaaauagacu

SEQ ID NO: 3191 - DNA, 27 bp; single-stranded, linear
  The letter "N" represents the stem II region of an HH ribozyme.
caacuaugcugaugangaaacauaaua

SEQ ID NO: 3192 - DNA, 27 bp; single-stranded, linear
  The letter "N" represents the stem II region of an HH ribozyme.
acgacaaccugaugangaaauguacau

SEQ ID NO: 3193 - DNA, 27 bp; single-stranded, linear
  The letter "N" represents the stem II region of an HH ribozyme.
acaacgaccugaugangaaacuaugua

SEQ ID NO: 3194 - DNA, 27 bp; single-stranded, linear
  The letter "N" represents the stem II region of an HH ribozyme.
ccuacaaccugaugangaaacaacuau

SEQ ID NO: 3195 - DNA, 27 bp; single-stranded, linear
  The letter "N" represents the stem II region of an HH ribozyme.
uacccuaccugaugangaaacgacaac

SEQ ID NO: 3196 - DNA, 27 bp; single-stranded, linear
  The letter "N" represents the stem II region of an HH ribozyme.
cuauaccccugaugangaaacaacgac

SEQ ID NO: 3197 - DNA, 27 bp; single-stranded, linear
  The letter "N" represents the stem II region of an HH ribozyme.
aaauccuacugaugangaaacccuaca

SEQ ID NO: 3198 - DNA, 27 bp; single-stranded, linear
  The letter "N" represents the stem II region of an HH ribozyme.
auaaaucccugaugangaaauacccua

SEQ ID NO: 3199 - DNA, 27 bp; single-stranded, linear
  The letter "N" represents the stem II region of an HH ribozyme.
acaucauacugaugangaaauccuaua

SEQ ID NO: 3200 - DNA, 27 bp; single-stranded, linear
  The letter "N" represents the stem II region of an HH ribozyme.
cacaucaucugaugangaaaauccuau

SEQ ID NO: 3201 - DNA, 27 bp; single-stranded, linear
  The letter "N" represents the stem II region of an HH ribozyme.
ccacaucacugaugangaaaaauccua

SEQ ID NO: 3202 - DNA, 27 bp; single-stranded, linear
  The letter "N" represents the stem II region of an HH ribozyme.
ggacucagcugaugangaaaccacauc

SEQ ID NO: 3203 - DNA, 27 bp; single-stranded, linear
  The letter "N" represents the stem II region of an HH ribozyme.
cggacucacugaugangaaaaccacau

SEQ ID NO: 3204 - DNA, 27 bp; single-stranded, linear
  The letter "N" represents the stem II region of an HH ribozyme.
augagacgcugaugangaaacucagaa

SEQ ID NO: 3205 - DNA, 27 bp; single-stranded, linear
  The letter "N" represents the stem II region of an HH ribozyme.
uuccaugacugaugangaaacggacuc

SEQ ID NO: 3206 - DNA, 27 bp; single-stranded, linear
  The letter "N" represents the stem II region of an HH ribozyme.
aauuccaucugaugangaaagacggac

SEQ ID NO: 3207 - DNA, 27 bp; single-stranded, linear
  The letter "N" represents the stem II region of an HH ribozyme.
gauaguuccugaugangaaauuccaug

SEQ ID NO: 3208 - DNA, 27 bp; single-stranded, linear
  The letter "N" represents the stem II region of an HH ribozyme.
ccaacagacugaugangaaaguucaau

SEQ ID NO: 3209 - DNA, 27 bp; single-stranded, linear
  The letter "N" represents the stem II region of an HH ribozyme.
cuccaacacugaugangaaauaguuca

SEQ ID NO: 3210 - DNA, 27 bp; single-stranded, linear
  The letter "N" represents the stem II region of an HH ribozyme.
uuuucucccugaugangaaacagauag

SEQ ID NO: 3211 - DNA, 27 bp; single-stranded, linear
  The letter "N" represents the stem II region of an HH ribozyme.
uuuaagaccugaugangaaagcuuuuc

SEQ ID NO: 3212 - DNA, 27 bp; single-stranded, linear
  The letter "N" represents the stem II region of an HH ribozyme.
caauuuaacugaugangaaacaagcuu

SEQ ID NO: 3213 - DNA, 27 bp; single-stranded, linear
  The letter "N" represents the stem II region of an HH ribozyme.
uacaauuucugaugangaaagacaagc

SEQ ID NO: 3214 - DNA, 27 bp; single-stranded, linear
  The letter "N" represents the stem II region of an HH ribozyme.
guacaauucugaugangaaaagacaag

SEQ ID NO: 3215 - DNA, 27 bp; single-stranded, linear
  The letter "N" represents the stem II region of an HH ribozyme.
ugcuguaccugaugangaaauuuaaga

SEQ ID NO: 3216 - DNA, 27 bp; single-stranded, linear
  The letter "N" represents the stem II region of an HH ribozyme.
ucuugcugcugaugangaaacaauuua

SEQ ID NO: 3217 - DNA, 27 bp; single-stranded, linear
  The letter "N" represents the stem II region of an HH ribozyme.
cccacauucugaugangaaaguucagu

SEQ ID NO: 3218 - DNA, 27 bp; single-stranded, linear
  The letter "N" represents the stem II region of an HH ribozyme.
uugaaguccugaugangaaauccccac

SEQ ID NO: 3219 - DNA, 27 bp; single-stranded, linear
  The letter "N" represents the stem II region of an HH ribozyme.
cccaguugcugaugangaaagucaauc

SEQ ID NO: 3220 - DNA, 27 bp; single-stranded, linear
  The letter "N" represents the stem II region of an HH ribozyme.
ucccaguucugaugangaaaagucaau

SEQ ID NO: 3221 - DNA, 27 bp; single-stranded, linear
  The letter "N" represents the stem II region of an HH ribozyme.
aagaagggcugaugangaaauucccag

SEQ ID NO: 3222 - DNA, 27 bp; single-stranded, linear
  The letter "N" represents the stem II region of an HH ribozyme.
cuucgaagcugaugangaaaggguauu

SEQ ID NO: 3223 - DNA, 27 bp; single-stranded, linear
  The letter "N" represents the stem II region of an HH ribozyme.
gcuucgaacugaugangaaaaggguau

SEQ ID NO: 3224 - DNA, 27 bp; single-stranded, linear
  The letter "N" represents the stem II region of an HH ribozyme.
augcuucgcugaugangaaagaagggu

SEQ ID NO: 3225 - DNA, 27 bp; single-stranded, linear
  The letter "N" represents the stem II region of an HH ribozyme.
gaugcuuccugaugangaaaagaaggg

SEQ ID NO: 3226 - DNA, 27 bp; single-stranded, linear
  The letter "N" represents the stem II region of an HH ribozyme.
cuuaugcucugaugangaaaugcuucg

SEQ ID NO: 3227 - DNA, 27 bp; single-stranded, linear
  The letter "N" represents the stem II region of an HH ribozyme.
aaguuucucugaugangaaaugcugau

SEQ ID NO: 3228 - DNA, 27 bp; single-stranded, linear
  The letter "N" represents the stem II region of an HH ribozyme.
cgguuuaccugaugangaaaguuucuu

SEQ ID NO: 3229 - DNA, 27 bp; single-stranded, linear
  The letter "N" represents the stem II region of an HH ribozyme.
ucucgguucugaugangaaacaaguuu

SEQ ID NO: 3230 - DNA, 27 bp; single-stranded, linear
  The letter "N" represents the stem II region of an HH ribozyme.
uggguuuucugaugangaaaggucucg

SEQ ID NO: 3231 - DNA, 27 bp; single-stranded, linear
  The letter "N" represents the stem II region of an HH ribozyme.
cacucccacugaugangaaacuggguu

SEQ ID NO: 3232 - DNA, 27 bp; single-stranded, linear
  The letter "N" represents the stem II region of an HH ribozyme.
ugcucaaacugaugangaaauuucuuc

SEQ ID NO: 3233 - DNA, 27 bp; single-stranded, linear
  The letter "N" represents the stem II region of an HH ribozyme.
gugcucaacugaugangaaaauuucuu

SEQ ID NO: 3234 - DNA, 27 bp; single-stranded, linear
  The letter "N" represents the stem II region of an HH ribozyme.
ggugcucacugaugangaaaaauuucu

SEQ ID NO: 3235 - DNA, 27 bp; single-stranded, linear
  The letter "N" represents the stem II region of an HH ribozyme.
aggugcuccugaugangaaaaaauuuc

SEQ ID NO: 3236 - DNA, 27 bp; single-stranded, linear
  The letter "N" represents the stem II region of an HH ribozyme.
cuauaguucugaugangaaaggugcuc

SEQ ID NO: 3237 - DNA, 27 bp; single-stranded, linear
  The letter "N" represents the stem II region of an HH ribozyme.
ucuauagucugaugangaaaaggugcu

SEQ ID NO: 3238 - DNA, 27 bp; single-stranded, linear
  The letter "N" represents the stem II region of an HH ribozyme.
accaucuacugaugangaaaguuaagg

SEQ ID NO: 3239 - DNA, 27 bp; single-stranded, linear
  The letter "N" represents the stem II region of an HH ribozyme.
acaccauccugaugangaaauaguuaa

SEQ ID NO: 3240 - DNA, 27 bp; single-stranded, linear
  The letter "N" represents the stem II region of an HH ribozyme.
cuccgggucugaugangaaacaccauc

SEQ ID NO: 3241 - DNA, 27 bp; single-stranded, linear
  The letter "N" represents the stem II region of an HH ribozyme.
agguguaccugaugangaaauccuugg

SEQ ID NO: 3242 - DNA, 27 bp; single-stranded, linear
  The letter "N" represents the stem II region of an HH ribozyme.
cacaggugcugaugangaaacaauccu

SEQ ID NO: 3243 - DNA, 27 bp; single-stranded, linear
  The letter "N" represents the stem II region of an HH ribozyme.
gcccacugcugaugangaaaugcugca

SEQ ID NO: 3244 - DNA, 27 bp; single-stranded, linear
  The letter "N" represents the stem II region of an HH ribozyme.
cccugacacugaugangaaaugugcug

SEQ ID NO: 3245 - DNA, 27 bp; single-stranded, linear
  The letter "N" represents the stem II region of an HH ribozyme.
acccugaccugaugangaaaaugugcu

SEQ ID NO: 3246 - DNA, 27 bp; single-stranded, linear
  The letter "N" represents the stem II region of an HH ribozyme.
uggacccucugaugangaaacaaaugu

SEQ ID NO: 3247 - DNA, 27 bp; single-stranded, linear
  The letter "N" represents the stem II region of an HH ribozyme.
uuuucaugcugaugangaaacccugac

SEQ ID NO: 3248 - DNA, 27 bp; single-stranded, linear
  The letter "N" represents the stem II region of an HH ribozyme.
agcaacaacugaugangaaagguuuuu

SEQ ID NO: 3249 - DNA, 27 bp; single-stranded, linear
  The letter "N" represents the stem II region of an HH ribozyme.
aagcaacacugaugangaaaagguuuu

SEQ ID NO: 3250 - DNA, 27 bp; single-stranded, linear
  The letter "N" represents the stem II region of an HH ribozyme.
aaagcaaccugaugangaaaaagguuu

SEQ ID NO: 3251 - DNA, 27 bp; single-stranded, linear
  The letter "N" represents the stem II region of an HH ribozyme.
ccaaaagccugaugangaaacaaaagg

SEQ ID NO: 3252 - DNA, 27 bp; single-stranded, linear
  The letter "N" represents the stem II region of an HH ribozyme.
acuuccaacugaugangaaagcaacaa

SEQ ID NO: 3253 - DNA, 27 bp; single-stranded, linear
  The letter "N" represents the stem II region of an HH ribozyme.
cacuuccacugaugangaaaagcaaca

SEQ ID NO: 3254 - DNA, 27 bp; single-stranded, linear
  The letter "N" represents the stem II region of an HH ribozyme.
ccacuucccugaugangaaaaagcaac

SEQ ID NO: 3255 - DNA, 27 bp; single-stranded, linear
  The letter "N" represents the stem II region of an HH ribozyme.
ccaccagacugaugangaaauuccaug

SEQ ID NO: 3256 - DNA, 27 bp; single-stranded, linear
  The letter "N" represents the stem II region of an HH ribozyme.
uuccaccacugaugangaaagauucca

SEQ ID NO: 3257 - DNA, 27 bp; single-stranded, linear
  The letter "N" represents the stem II region of an HH ribozyme.
gggauucucugaugangaaacacgcuc

SEQ ID NO: 3258 - DNA, 27 bp; single-stranded, linear
  The letter "N" represents the stem II region of an HH ribozyme.
uucgcaggcugaugangaaauucugac

SEQ ID NO: 3259 - DNA, 27 bp; single-stranded, linear
  The letter "N" represents the stem II region of an HH ribozyme.
aaccaaggcugaugangaaacuucgca

SEQ ID NO: 3260 - DNA, 27 bp; single-stranded, linear
  The letter "N" represents the stem II region of an HH ribozyme.
ggguaacccugaugangaaagguacuu

SEQ ID NO: 3261 - DNA, 27 bp; single-stranded, linear
  The letter "N" represents the stem II region of an HH ribozyme.
gggugggucugaugangaaaccaaggu

SEQ ID NO: 3262 - DNA, 27 bp; single-stranded, linear
  The letter "N" represents the stem II region of an HH ribozyme.
ggggugggcugaugangaaaaccaagg

SEQ ID NO: 3263 - DNA, 27 bp; single-stranded, linear
  The letter "N" represents the stem II region of an HH ribozyme.
uaccauuucugaugangaaauuucugg

SEQ ID NO: 3264 - DNA, 27 bp; single-stranded, linear
  The letter "N" represents the stem II region of an HH ribozyme.
cauuuuuacugaugangaaaccauuuu

SEQ ID NO: 3265 - DNA, 27 bp; single-stranded, linear
  The letter "N" represents the stem II region of an HH ribozyme.
uccauuuucugaugangaaauaccauu

SEQ ID NO: 3266 - DNA, 27 bp; single-stranded, linear
  The letter "N" represents the stem II region of an HH ribozyme.
ucaaggggcugaugangaaauuccauu

SEQ ID NO: 3267 - DNA, 27 bp; single-stranded, linear
  The letter "N" represents the stem II region of an HH ribozyme.
uuggacuccugaugangaaagggguau

SEQ ID NO: 3268 - DNA, 27 bp; single-stranded, linear
  The letter "N" represents the stem II region of an HH ribozyme.
ugugauugcugaugangaaacucaagg

SEQ ID NO: 3269 - DNA, 27 bp; single-stranded, linear
  The letter "N" represents the stem II region of an HH ribozyme.
aauugugucugaugangaaauuggacu

SEQ ID NO: 3270 - DNA, 27 bp; single-stranded, linear
  The letter "N" represents the stem II region of an HH ribozyme.
cccgcuuucugaugangaaauugugug

SEQ ID NO: 3271 - DNA, 27 bp; single-stranded, linear
  The letter "N" represents the stem II region of an HH ribozyme.
ccccgcuucugaugangaaaauugugu

SEQ ID NO: 3272 - DNA, 27 bp; single-stranded, linear
  The letter "N" represents the stem II region of an HH ribozyme.
aucgucagcugaugangaaacaugccc

SEQ ID NO: 3273 - DNA, 27 bp; single-stranded, linear
  The letter "N" represents the stem II region of an HH ribozyme.
acuuccaucugaugangaaaucgucag

SEQ ID NO: 3274 - DNA, 27 bp; single-stranded, linear
  The letter "N" represents the stem II region of an HH ribozyme.
cacuuccacugaugangaaaaucguca

SEQ ID NO: 3275 - DNA, 27 bp; single-stranded, linear
  The letter "N" represents the stem II region of an HH ribozyme.
gacagugucugaugangaaauuuccug

SEQ ID NO: 3276 - DNA, 27 bp; single-stranded, linear
  The letter "N" represents the stem II region of an HH ribozyme.
ugacagugcugaugangaaaauuuccu

SEQ ID NO: 3277 - DNA, 27 bp; single-stranded, linear
  The letter "N" represents the stem II region of an HH ribozyme.
guaaggaucugaugangaaacagugua

SEQ ID NO: 3278 - DNA, 27 bp; single-stranded, linear
  The letter "N" represents the stem II region of an HH ribozyme.
uugguaagcugaugangaaaugacagu

SEQ ID NO: 3279 - DNA, 27 bp; single-stranded, linear
  The letter "N" represents the stem II region of an HH ribozyme.
ggauuggucugaugangaaaggaugac

SEQ ID NO: 3280 - DNA, 27 bp; single-stranded, linear
  The letter "N" represents the stem II region of an HH ribozyme.
gggauuggcugaugangaaaaggauga

SEQ ID NO: 3281 - DNA, 27 bp; single-stranded, linear
  The letter "N" represents the stem II region of an HH ribozyme.
ugaaauggcugaugangaaauugguaa

SEQ ID NO: 3282 - DNA, 27 bp; single-stranded, linear
  The letter "N" represents the stem II region of an HH ribozyme.
uccuuugacugaugangaaaugggauu

SEQ ID NO: 3283 - DNA, 27 bp; single-stranded, linear
  The letter "N" represents the stem II region of an HH ribozyme.
cuccuuugcugaugangaaaaugggau

SEQ ID NO: 3284 - DNA, 27 bp; single-stranded, linear
  The letter "N" represents the stem II region of an HH ribozyme.
ucuccuuucugaugangaaaaauggga

SEQ ID NO: 3285 - DNA, 27 bp; single-stranded, linear
  The letter "N" represents the stem II region of an HH ribozyme.
accagagacugaugangaaaccacaug

SEQ ID NO: 3286 - DNA, 27 bp; single-stranded, linear
  The letter "N" represents the stem II region of an HH ribozyme.
caaccagacugaugangaaagaccaca

SEQ ID NO: 3287 - DNA, 27 bp; single-stranded, linear
  The letter "N" represents the stem II region of an HH ribozyme.
cacaaccacugaugangaaagagacca

SEQ ID NO: 3288 - DNA, 27 bp; single-stranded, linear
  The letter "N" represents the stem II region of an HH ribozyme.
acauacaccugaugangaaaccagaga

SEQ ID NO: 3289 - DNA, 27 bp; single-stranded, linear
  The letter "N" represents the stem II region of an HH ribozyme.
gugggacacugaugangaaacacaacc

SEQ ID NO: 3290 - DNA, 27 bp; single-stranded, linear
  The letter "N" represents the stem II region of an HH ribozyme.
ugggguggcugaugangaaacauacac

SEQ ID NO: 3291 - DNA, 27 bp; single-stranded, linear
  The letter "N" represents the stem II region of an HH ribozyme.
uucucacccugaugangaaaucugggg

SEQ ID NO: 3292 - DNA, 27 bp; single-stranded, linear
  The letter "N" represents the stem II region of an HH ribozyme.
agauuagacugaugangaaauuucuca

SEQ ID NO: 3293 - DNA, 27 bp; single-stranded, linear
  The letter "N" represents the stem II region of an HH ribozyme.
agagauuacugaugangaaagauuucu

SEQ ID NO: 3294 - DNA, 27 bp; single-stranded, linear
  The letter "N" represents the stem II region of an HH ribozyme.
ggagagaucugaugangaaagagauuu

SEQ ID NO: 3295 - DNA, 27 bp; single-stranded, linear
  The letter "N" represents the stem II region of an HH ribozyme.
acaggagacugaugangaaauuagaga

SEQ ID NO: 3296 - DNA, 27 bp; single-stranded, linear
  The letter "N" represents the stem II region of an HH ribozyme.
ccacaggacugaugangaaagauuaga

SEQ ID NO: 3297 - DNA, 27 bp; single-stranded, linear
  The letter "N" represents the stem II region of an HH ribozyme.
auccacagcugaugangaaagagauua

SEQ ID NO: 3298 - DNA, 27 bp; single-stranded, linear
  The letter "N" represents the stem II region of an HH ribozyme.
cugguaggcugaugangaaauccacag

SEQ ID NO: 3299 - DNA, 27 bp; single-stranded, linear
  The letter "N" represents the stem II region of an HH ribozyme.
acugguagcugaugangaaaauccaca

SEQ ID NO: 3300 - DNA, 27 bp; single-stranded, linear
  The letter "N" represents the stem II region of an HH ribozyme.
cguacuggcugaugangaaaggaaucc

SEQ ID NO: 3301 - DNA, 27 bp; single-stranded, linear
  The letter "N" represents the stem II region of an HH ribozyme.
uggugccgcugaugangaaacugguag

SEQ ID NO: 3302 - DNA, 27 bp; single-stranded, linear
  The letter "N" represents the stem II region of an HH ribozyme.
cagcguuucugaugangaaaguggugc

SEQ ID NO: 3303 - DNA, 27 bp; single-stranded, linear
  The letter "N" represents the stem II region of an HH ribozyme.
auagaccgcugaugangaaacauguca

SEQ ID NO: 3304 - DNA, 27 bp; single-stranded, linear
  The letter "N" represents the stem II region of an HH ribozyme.
auggcauacugaugangaaaccguaca

SEQ ID NO: 3305 - DNA, 27 bp; single-stranded, linear
  The letter "N" represents the stem II region of an HH ribozyme.
gaauggcacugaugangaaagaccgua

SEQ ID NO: 3306 - DNA, 27 bp; single-stranded, linear
  The letter "N" represents the stem II region of an HH ribozyme.
gggggaggcugaugangaaauggcaua

SEQ ID NO: 3307 - DNA, 27 bp; single-stranded, linear
  The letter "N" represents the stem II region of an HH ribozyme.
cgggggagcugaugangaaaauggcau

SEQ ID NO: 3308 - DNA, 27 bp; single-stranded, linear
  The letter "N" represents the stem II region of an HH ribozyme.
augcggggcugaugangaaaggaaugg

SEQ ID NO: 3309 - DNA, 27 bp; single-stranded, linear
  The letter "N" represents the stem II region of an HH ribozyme.
guggaugucugaugangaaaugcgggg

SEQ ID NO: 3310 - DNA, 27 bp; single-stranded, linear
  The letter "N" represents the stem II region of an HH ribozyme.
uaccagugcugaugangaaaugugaug

SEQ ID NO: 3311 - DNA, 27 bp; single-stranded, linear
  The letter "N" represents the stem II region of an HH ribozyme.
acugccaacugaugangaaaccagugg

SEQ ID NO: 3312 - DNA, 27 bp; single-stranded, linear
  The letter "N" represents the stem II region of an HH ribozyme.
caacugcccugaugangaaauaccagu

SEQ ID NO: 3313 - DNA, 27 bp; single-stranded, linear
  The letter "N" represents the stem II region of an HH ribozyme.
cuuccucccugaugangaaacugccaa

SEQ ID NO: 3314 - DNA, 27 bp; single-stranded, linear
  The letter "N" represents the stem II region of an HH ribozyme.
gucacugacugaugangaaacagcuug

SEQ ID NO: 3315 - DNA, 27 bp; single-stranded, linear
  The letter "N" represents the stem II region of an HH ribozyme.
uugucacucugaugangaaagacagcu

SEQ ID NO: 3316 - DNA, 27 bp; single-stranded, linear
  The letter "N" represents the stem II region of an HH ribozyme.
cacaagggcugaugangaaauggguuu

SEQ ID NO: 3317 - DNA, 27 bp; single-stranded, linear
  The letter "N" represents the stem II region of an HH ribozyme.
uucuucaccugaugangaaaggguaug

SEQ ID NO: 3318 - DNA, 27 bp; single-stranded, linear
  The letter "N" represents the stem II region of an HH ribozyme.
cucccuggcugaugangaaaguccucc

SEQ ID NO: 3319 - DNA, 27 bp; single-stranded, linear
  The letter "N" represents the stem II region of an HH ribozyme.
ccucccugcugaugangaaaaguccuc

SEQ ID NO: 3320 - DNA, 27 bp; single-stranded, linear
  The letter "N" represents the stem II region of an HH ribozyme.
uucaauuucugaugangaaauuuccuc

SEQ ID NO: 3321 - DNA, 27 bp; single-stranded, linear
  The letter "N" represents the stem II region of an HH ribozyme.
uuaacuuccugaugangaaauuuuauu

SEQ ID NO: 3322 - DNA, 27 bp; single-stranded, linear
  The letter "N" represents the stem II region of an HH ribozyme.
uuuuuauucugaugangaaacuucaau

SEQ ID NO: 3323 - DNA, 27 bp; single-stranded, linear
  The letter "N" represents the stem II region of an HH ribozyme.
auuuuuaucugaugangaaaacuucaa

SEQ ID NO: 3324 - DNA, 27 bp; single-stranded, linear
  The letter "N" represents the stem II region of an HH ribozyme.
uugauuuucugaugangaaauuaacuu

SEQ ID NO: 3325 - DNA, 27 bp; single-stranded, linear
  The letter "N" represents the stem II region of an HH ribozyme.
agcaaauucugaugangaaauuuuuau

SEQ ID NO: 3326 - DNA, 27 bp; single-stranded, linear
  The letter "N" represents the stem II region of an HH ribozyme.
uuagagcacugaugangaaauugauuu

SEQ ID NO: 3327 - DNA, 27 bp; single-stranded, linear
  The letter "N" represents the stem II region of an HH ribozyme.
auuagagccugaugangaaaauugauu

SEQ ID NO: 3328 - DNA, 27 bp; single-stranded, linear
  The letter "N" represents the stem II region of an HH ribozyme.
uucaauuacugaugangaaagcaaauu

SEQ ID NO: 3329 - DNA, 27 bp; single-stranded, linear
  The letter "N" represents the stem II region of an HH ribozyme.
ccuucaaucugaugangaaagagcaaa

SEQ ID NO: 3330 - DNA, 27 bp; single-stranded, linear
  The letter "N" represents the stem II region of an HH ribozyme.
uuuccuuccugaugangaaauuagagc

SEQ ID NO: 3331 - DNA, 27 bp; single-stranded, linear
  The letter "N" represents the stem II region of an HH ribozyme.
aggguacucugaugangaaacaguuuu

SEQ ID NO: 3332 - DNA, 27 bp; single-stranded, linear
  The letter "N" represents the stem II region of an HH ribozyme.
aacaagggcugaugangaaacuuacag

SEQ ID NO: 3333 - DNA, 27 bp; single-stranded, linear
  The letter "N" represents the stem II region of an HH ribozyme.
uggauaaccugaugangaaaggguacu

SEQ ID NO: 3334 - DNA, 27 bp; single-stranded, linear
  The letter "N" represents the stem II region of an HH ribozyme.
gcuuggaucugaugangaaacaagggu

SEQ ID NO: 3335 - DNA, 27 bp; single-stranded, linear
  The letter "N" represents the stem II region of an HH ribozyme.
cgcuuggacugaugangaaaacaaggg

SEQ ID NO: 3336 - DNA, 27 bp; single-stranded, linear
  The letter "N" represents the stem II region of an HH ribozyme.
gccgcuugcugaugangaaauaacaag

SEQ ID NO: 3337 - DNA, 27 bp; single-stranded, linear
  The letter "N" represents the stem II region of an HH ribozyme.
acaaagcucugaugangaaacacauuu

SEQ ID NO: 3338 - DNA, 27 bp; single-stranded, linear
  The letter "N" represents the stem II region of an HH ribozyme.
uuuguacacugaugangaaagcugaca

SEQ ID NO: 3339 - DNA, 27 bp; single-stranded, linear
  The letter "N" represents the stem II region of an HH ribozyme.
auuuguaccugaugangaaaagcugac

SEQ ID NO: 3340 - DNA, 27 bp; single-stranded, linear
  The letter "N" represents the stem II region of an HH ribozyme.
cacauuugcugaugangaaacaaagcu

SEQ ID NO: 3341 - DNA, 27 bp; single-stranded, linear
  The letter "N" represents the stem II region of an HH ribozyme.
acuuuguucugaugangaaaccgcuuc

SEQ ID NO: 3342 - DNA, 27 bp; single-stranded, linear
  The letter "N" represents the stem II region of an HH ribozyme.
ccucuccccugaugangaaacuuuguu

SEQ ID NO: 3343 - DNA, 27 bp; single-stranded, linear
  The letter "N" represents the stem II region of an HH ribozyme.
uggaaggacugaugangaaaucacccu

SEQ ID NO: 3344 - DNA, 27 bp; single-stranded, linear
  The letter "N" represents the stem II region of an HH ribozyme.
cguggaagcugaugangaaagaucacc

SEQ ID NO: 3345 - DNA, 27 bp; single-stranded, linear
  The letter "N" represents the stem II region of an HH ribozyme.
ucacguggcugaugangaaaggagauc

SEQ ID NO: 3346 - DNA, 27 bp; single-stranded, linear
  The letter "N" represents the stem II region of an HH ribozyme.
gucacgugcugaugangaaaaggagau

SEQ ID NO: 3347 - DNA, 27 bp; single-stranded, linear
  The letter "N" represents the stem II region of an HH ribozyme.
aauuucagcugaugangaaaccccugg

SEQ ID NO: 3348 - DNA, 27 bp; single-stranded, linear
  The letter "N" represents the stem II region of an HH ribozyme.
ugcaaagucugaugangaaauuucagg

SEQ ID NO: 3349 - DNA, 27 bp; single-stranded, linear
  The letter "N" represents the stem II region of an HH ribozyme.
uugcaaagcugaugangaaaauuucag

SEQ ID NO: 3350 - DNA, 27 bp; single-stranded, linear
  The letter "N" represents the stem II region of an HH ribozyme.
agguugcacugaugangaaaguaauuu

SEQ ID NO: 3351 - DNA, 27 bp; single-stranded, linear
  The letter "N" represents the stem II region of an HH ribozyme.
cagguugccugaugangaaaaguaauu

SEQ ID NO: 3352 - DNA, 27 bp; single-stranded, linear
  The letter "N" represents the stem II region of an HH ribozyme.
accacaaacugaugangaaacacgcuc

SEQ ID NO: 3353 - DNA, 27 bp; single-stranded, linear
  The letter "N" represents the stem II region of an HH ribozyme.
gcaccacacugaugangaaagacacgc

SEQ ID NO: 3354 - DNA, 27 bp; single-stranded, linear
  The letter "N" represents the stem II region of an HH ribozyme.
ugcaccaccugaugangaaaagacacg

SEQ ID NO: 3355 - DNA, 27 bp; single-stranded, linear
  The letter "N" represents the stem II region of an HH ribozyme.
caaacguacugaugangaaaucugucu

SEQ ID NO: 3356 - DNA, 27 bp; single-stranded, linear
  The letter "N" represents the stem II region of an HH ribozyme.
cucaaacgcugaugangaaagaucugu

SEQ ID NO: 3357 - DNA, 27 bp; single-stranded, linear
  The letter "N" represents the stem II region of an HH ribozyme.
gguucucacugaugangaaacguagau

SEQ ID NO: 3358 - DNA, 27 bp; single-stranded, linear
  The letter "N" represents the stem II region of an HH ribozyme.
agguucuccugaugangaaaacguaga

SEQ ID NO: 3359 - DNA, 27 bp; single-stranded, linear
  The letter "N" represents the stem II region of an HH ribozyme.
uaccaugucugaugangaaagguucuc

SEQ ID NO: 3360 - DNA, 27 bp; single-stranded, linear
  The letter "N" represents the stem II region of an HH ribozyme.
caagcuugcugaugangaaaccaugug

SEQ ID NO: 3361 - DNA, 27 bp; single-stranded, linear
  The letter "N" represents the stem II region of an HH ribozyme.
ugugggcccugaugangaaagcuugua

SEQ ID NO: 3362 - DNA, 27 bp; single-stranded, linear
  The letter "N" represents the stem II region of an HH ribozyme.
gauuggcacugaugangaaaggcugug

SEQ ID NO: 3363 - DNA, 27 bp; single-stranded, linear
  The letter "N" represents the stem II region of an HH ribozyme.
cccacaugcugaugangaaauuggcag

SEQ ID NO: 3364 - DNA, 27 bp; single-stranded, linear
  The letter "N" represents the stem II region of an HH ribozyme.
gugugggccugaugangaaacucuccc

SEQ ID NO: 3365 - DNA, 27 bp; single-stranded, linear
  The letter "N" represents the stem II region of an HH ribozyme.
uucuugcacugaugangaaacaggugu

SEQ ID NO: 3366 - DNA, 27 bp; single-stranded, linear
  The letter "N" represents the stem II region of an HH ribozyme.
guucuugccugaugangaaaacaggug

SEQ ID NO: 3367 - DNA, 27 bp; single-stranded, linear
  The letter "N" represents the stem II region of an HH ribozyme.
gaguaucccugaugangaaaguucuug

SEQ ID NO: 3368 - DNA, 27 bp; single-stranded, linear
  The letter "N" represents the stem II region of an HH ribozyme.
ccaaagagcugaugangaaauccaagu

SEQ ID NO: 3369 - DNA, 27 bp; single-stranded, linear
  The letter "N" represents the stem II region of an HH ribozyme.
uuuccaaacugaugangaaaguaucca

SEQ ID NO: 3370 - DNA, 27 bp; single-stranded, linear
  The letter "N" represents the stem II region of an HH ribozyme.
aauuuccacugaugangaaagaguauc

SEQ ID NO: 3371 - DNA, 27 bp; single-stranded, linear
  The letter "N" represents the stem II region of an HH ribozyme.
caauuucccugaugangaaaagaguau

SEQ ID NO: 3372 - DNA, 27 bp; single-stranded, linear
  The letter "N" represents the stem II region of an HH ribozyme.
uggcauuccugaugangaaauuuccaa

SEQ ID NO: 3373 - DNA, 27 bp; single-stranded, linear
  The letter "N" represents the stem II region of an HH ribozyme.
uauuagagcugaugangaaacauggug

SEQ ID NO: 3374 - DNA, 27 bp; single-stranded, linear
  The letter "N" represents the stem II region of an HH ribozyme.
cuauuagacugaugangaaaacauggu

SEQ ID NO: 3375 - DNA, 27 bp; single-stranded, linear
  The letter "N" represents the stem II region of an HH ribozyme.
ugcuauuacugaugangaaagaacaug

SEQ ID NO: 3376 - DNA, 27 bp; single-stranded, linear
  The letter "N" represents the stem II region of an HH ribozyme.
ugugcuaucugaugangaaagagaaca

SEQ ID NO: 3377 - DNA, 27 bp; single-stranded, linear
  The letter "N" represents the stem II region of an HH ribozyme.
auuugugccugaugangaaauuagaga

SEQ ID NO: 3378 - DNA, 27 bp; single-stranded, linear
  The letter "N" represents the stem II region of an HH ribozyme.
augaucaacugaugangaaaugucauu

SEQ ID NO: 3379 - DNA, 27 bp; single-stranded, linear
  The letter "N" represents the stem II region of an HH ribozyme.
caugaucacugaugangaaaaugucau

SEQ ID NO: 3380 - DNA, 27 bp; single-stranded, linear
  The letter "N" represents the stem II region of an HH ribozyme.
ccaugauccugaugangaaaaauguca

SEQ ID NO: 3381 - DNA, 27 bp; single-stranded, linear
  The letter "N" represents the stem II region of an HH ribozyme.
agcuccaucugaugangaaaucaaaau

SEQ ID NO: 3382 - DNA, 27 bp; single-stranded, linear
  The letter "N" represents the stem II region of an HH ribozyme.
gcauucuucugaugangaaagcuccau

SEQ ID NO: 3383 - DNA, 27 bp; single-stranded, linear
  The letter "N" represents the stem II region of an HH ribozyme.
ugcauucucugaugangaaaagcucca

SEQ ID NO: 3384 - DNA, 27 bp; single-stranded, linear
  The letter "N" represents the stem II region of an HH ribozyme.
ccugcaagcugaugangaaaugcauuc

SEQ ID NO: 3385 - DNA, 27 bp; single-stranded, linear
  The letter "N" represents the stem II region of an HH ribozyme.
gguccugccugaugangaaaggaugca

SEQ ID NO: 3386 - DNA, 27 bp; single-stranded, linear
  The letter "N" represents the stem II region of an HH ribozyme.
ggcagacacugaugangaaagucuccu

SEQ ID NO: 3387 - DNA, 27 bp; single-stranded, linear
  The letter "N" represents the stem II region of an HH ribozyme.
gcaaggcacugaugangaaacauaguc

SEQ ID NO: 3388 - DNA, 27 bp; single-stranded, linear
  The letter "N" represents the stem II region of an HH ribozyme.
ucuugagccugaugangaaaggcagac

SEQ ID NO: 3389 - DNA, 27 bp; single-stranded, linear
  The letter "N" represents the stem II region of an HH ribozyme.
ccugucuucugaugangaaagcaaggc

SEQ ID NO: 3390 - DNA, 27 bp; single-stranded, linear
  The letter "N" represents the stem II region of an HH ribozyme.
gaccacgccugaugangaaaugucuuu

SEQ ID NO: 3391 - DNA, 27 bp; single-stranded, linear
  The letter "N" represents the stem II region of an HH ribozyme.
agcugccucugaugangaaaccacgca

SEQ ID NO: 3392 - DNA, 27 bp; single-stranded, linear
  The letter "N" represents the stem II region of an HH ribozyme.
aggacugucugaugangaaagcugccu

SEQ ID NO: 3393 - DNA, 27 bp; single-stranded, linear
  The letter "N" represents the stem II region of an HH ribozyme.
cgcucuagcugaugangaaacugugag

SEQ ID NO: 3394 - DNA, 27 bp; single-stranded, linear
  The letter "N" represents the stem II region of an HH ribozyme.
acacgcuccugaugangaaaggacugu

SEQ ID NO: 3395 - DNA, 27 bp; single-stranded, linear
  The letter "N" represents the stem II region of an HH ribozyme.
uuuccugucugaugangaaaucguggg

SEQ ID NO: 3396 - DNA, 27 bp; single-stranded, linear
  The letter "N" represents the stem II region of an HH ribozyme.
ugucgucucugaugangaaauucucca

SEQ ID NO: 3397 - DNA, 27 bp; single-stranded, linear
  The letter "N" represents the stem II region of an HH ribozyme.
uuccccaacugaugangaaacuugucg

SEQ ID NO: 3398 - DNA, 27 bp; single-stranded, linear
  The letter "N" represents the stem II region of an HH ribozyme.
cuuucccccugaugangaaauacuugu

SEQ ID NO: 3399 - DNA, 27 bp; single-stranded, linear
  The letter "N" represents the stem II region of an HH ribozyme.
gagacuuccugaugangaaaugcuuuc

SEQ ID NO: 3400 - DNA, 27 bp; single-stranded, linear
  The letter "N" represents the stem II region of an HH ribozyme.
gugcaugacugaugangaaacuucgau

SEQ ID NO: 3401 - DNA, 27 bp; single-stranded, linear
  The letter "N" represents the stem II region of an HH ribozyme.
ccgugcaucugaugangaaagacuucg

SEQ ID NO: 3402 - DNA, 27 bp; single-stranded, linear
  The letter "N" represents the stem II region of an HH ribozyme.
gauucccacugaugangaaaugccgug

SEQ ID NO: 3403 - DNA, 27 bp; single-stranded, linear
  The letter "N" represents the stem II region of an HH ribozyme.
uggaggggcugaugangaaauucccag

SEQ ID NO: 3404 - DNA, 27 bp; single-stranded, linear
  The letter "N" represents the stem II region of an HH ribozyme.
gaucugugcugaugangaaagggggau

SEQ ID NO: 3405 - DNA, 27 bp; single-stranded, linear
  The letter "N" represents the stem II region of an HH ribozyme.
aaccacaucugaugangaaaucugugg

SEQ ID NO: 3406 - DNA, 27 bp; single-stranded, linear
  The letter "N" represents the stem II region of an HH ribozyme.
uaucuuuacugaugangaaaccacaug

SEQ ID NO: 3407 - DNA, 27 bp; single-stranded, linear
  The letter "N" represents the stem II region of an HH ribozyme.
uuaucuuucugaugangaaaaccacau

SEQ ID NO: 3408 - DNA, 27 bp; single-stranded, linear
  The letter "N" represents the stem II region of an HH ribozyme.
auuaucuucugaugangaaaaaccaca

SEQ ID NO: 3409 - DNA, 27 bp; single-stranded, linear
  The letter "N" represents the stem II region of an HH ribozyme.
ggucucaucugaugangaaaucuuuaa

SEQ ID NO: 3410 - DNA, 27 bp; single-stranded, linear
  The letter "N" represents the stem II region of an HH ribozyme.
ucuucuaccugaugangaaagggucuc

SEQ ID NO: 3411 - DNA, 27 bp; single-stranded, linear
  The letter "N" represents the stem II region of an HH ribozyme.
gagucuuccugaugangaaacaagggu

SEQ ID NO: 3412 - DNA, 27 bp; single-stranded, linear
  The letter "N" represents the stem II region of an HH ribozyme.
caaugccucugaugangaaagucuucu

SEQ ID NO: 3413 - DNA, 27 bp; single-stranded, linear
  The letter "N" represents the stem II region of an HH ribozyme.
uucaauaccugaugangaaaugccuga

SEQ ID NO: 3414 - DNA, 27 bp; single-stranded, linear
  The letter "N" represents the stem II region of an HH ribozyme.
uccuucaacugaugangaaacaaugcc

SEQ ID NO: 3415 - DNA, 27 bp; single-stranded, linear
  The letter "N" represents the stem II region of an HH ribozyme.
cauccuuccugaugangaaauacaaug

SEQ ID NO: 3416 - DNA, 27 bp; single-stranded, linear
  The letter "N" represents the stem II region of an HH ribozyme.
cggauagucugaugangaaagguuccg

SEQ ID NO: 3417 - DNA, 27 bp; single-stranded, linear
  The letter "N" represents the stem II region of an HH ribozyme.
ucugcggacugaugangaaagugaggu

SEQ ID NO: 3418 - DNA, 27 bp; single-stranded, linear
  The letter "N" represents the stem II region of an HH ribozyme.
acucugcgcugaugangaaauagugag

SEQ ID NO: 3419 - DNA, 27 bp; single-stranded, linear
  The letter "N" represents the stem II region of an HH ribozyme.
cagguguacugaugangaaaggccuuc

SEQ ID NO: 3420 - DNA, 27 bp; single-stranded, linear
  The letter "N" represents the stem II region of an HH ribozyme.
ggcaggugcugaugangaaagaggccu

SEQ ID NO: 3421 - DNA, 27 bp; single-stranded, linear
  The letter "N" represents the stem II region of an HH ribozyme.
cagccaagcugaugangaaacacugca

SEQ ID NO: 3422 - DNA, 27 bp; single-stranded, linear
  The letter "N" represents the stem II region of an HH ribozyme.
acagccaacugaugangaaaacacugc

SEQ ID NO: 3423 - DNA, 27 bp; single-stranded, linear
  The letter "N" represents the stem II region of an HH ribozyme.
gcacagcccugaugangaaagaacacu

SEQ ID NO: 3424 - DNA, 27 bp; single-stranded, linear
  The letter "N" represents the stem II region of an HH ribozyme.
uuaugaaacugaugangaaaugccucc

SEQ ID NO: 3425 - DNA, 27 bp; single-stranded, linear
  The letter "N" represents the stem II region of an HH ribozyme.
auuaugaacugaugangaaaaugccuc

SEQ ID NO: 3426 - DNA, 27 bp; single-stranded, linear
  The letter "N" represents the stem II region of an HH ribozyme.
uauuaugacugaugangaaaaaugccu

SEQ ID NO: 3427 - DNA, 27 bp; single-stranded, linear
  The letter "N" represents the stem II region of an HH ribozyme.
cuauuaugcugaugangaaaaaaugcc

SEQ ID NO: 3428 - DNA, 27 bp; single-stranded, linear
  The letter "N" represents the stem II region of an HH ribozyme.
ucuauuaucugaugangaaaaaaaugc

SEQ ID NO: 3429 - DNA, 27 bp; single-stranded, linear
  The letter "N" represents the stem II region of an HH ribozyme.
ccuucuaucugaugangaaaugaaaaa

SEQ ID NO: 3430 - DNA, 27 bp; single-stranded, linear
  The letter "N" represents the stem II region of an HH ribozyme.
gcaccuuccugaugangaaauuaugaa

SEQ ID NO: 3431 - DNA, 27 bp; single-stranded, linear
  The letter "N" represents the stem II region of an HH ribozyme.
ugauuucccugaugangaaaguucguc

SEQ ID NO: 3432 - DNA, 27 bp; single-stranded, linear
  The letter "N" represents the stem II region of an HH ribozyme.
agaauaaucugaugangaaauuuccaa

SEQ ID NO: 3433 - DNA, 27 bp; single-stranded, linear
  The letter "N" represents the stem II region of an HH ribozyme.
acuagaaucugaugangaaaugauuuc

SEQ ID NO: 3434 - DNA, 27 bp; single-stranded, linear
  The letter "N" represents the stem II region of an HH ribozyme.
uacuagaacugaugangaaaaugauuu

SEQ ID NO: 3435 - DNA, 27 bp; single-stranded, linear
  The letter "N" represents the stem II region of an HH ribozyme.
ccuacuagcugaugangaaauaaugau

SEQ ID NO: 3436 - DNA, 27 bp; single-stranded, linear
  The letter "N" represents the stem II region of an HH ribozyme.
gccuacuacugaugangaaaauaauga

SEQ ID NO: 3437 - DNA, 27 bp; single-stranded, linear
  The letter "N" represents the stem II region of an HH ribozyme.
gugccuaccugaugangaaagaauaau

SEQ ID NO: 3438 - DNA, 27 bp; single-stranded, linear
  The letter "N" represents the stem II region of an HH ribozyme.
gucgugcccugaugangaaacuagaau

SEQ ID NO: 3439 - DNA, 27 bp; single-stranded, linear
  The letter "N" represents the stem II region of an HH ribozyme.
aacauggccugaugangaaaucaccgu

SEQ ID NO: 3440 - DNA, 27 bp; single-stranded, linear
  The letter "N" represents the stem II region of an HH ribozyme.
gccagaagcugaugangaaacauggca

SEQ ID NO: 3441 - DNA, 27 bp; single-stranded, linear
  The letter "N" represents the stem II region of an HH ribozyme.
agccagaacugaugangaaaacauggc

SEQ ID NO: 3442 - DNA, 27 bp; single-stranded, linear
  The letter "N" represents the stem II region of an HH ribozyme.
guagccagcugaugangaaagaacaug

SEQ ID NO: 3443 - DNA, 27 bp; single-stranded, linear
  The letter "N" represents the stem II region of an HH ribozyme.
aguagccacugaugangaaaagaacau

SEQ ID NO: 3444 - DNA, 27 bp; single-stranded, linear
  The letter "N" represents the stem II region of an HH ribozyme.
acaagaagcugaugangaaagccagaa

SEQ ID NO: 3445 - DNA, 27 bp; single-stranded, linear
  The letter "N" represents the stem II region of an HH ribozyme.
augacaagcugaugangaaaguagcca

SEQ ID NO: 3446 - DNA, 27 bp; single-stranded, linear
  The letter "N" represents the stem II region of an HH ribozyme.
gaugacaacugaugangaaaaguagcc

SEQ ID NO: 3447 - DNA, 27 bp; single-stranded, linear
  The letter "N" represents the stem II region of an HH ribozyme.
augaugaccugaugangaaagaaguag

SEQ ID NO: 3448 - DNA, 27 bp; single-stranded, linear
  The letter "N" represents the stem II region of an HH ribozyme.
aggaugaucugaugangaaacaagaag

SEQ ID NO: 3449 - DNA, 27 bp; single-stranded, linear
  The letter "N" represents the stem II region of an HH ribozyme.
ccuaggaucugaugangaaaugacaag

SEQ ID NO: 3450 - DNA, 27 bp; single-stranded, linear
  The letter "N" represents the stem II region of an HH ribozyme.
gucccuagcugaugangaaaugaugac

SEQ ID NO: 3451 - DNA, 27 bp; single-stranded, linear
  The letter "N" represents the stem II region of an HH ribozyme.
acgguccccugaugangaaaggaugau

SEQ ID NO: 3452 - DNA, 27 bp; single-stranded, linear
  The letter "N" represents the stem II region of an HH ribozyme.
gcccgcuucugaugangaaacgguccc

SEQ ID NO: 3453 - DNA, 27 bp; single-stranded, linear
  The letter "N" represents the stem II region of an HH ribozyme.
ggcccgcucugaugangaaaacggucc

SEQ ID NO: 3454 - DNA, 27 bp; single-stranded, linear
  The letter "N" represents the stem II region of an HH ribozyme.
uggacaagcugaugangaaagccuguc

SEQ ID NO: 3455 - DNA, 27 bp; single-stranded, linear
  The letter "N" represents the stem II region of an HH ribozyme.
cgauggaccugaugangaaaguagccu

SEQ ID NO: 3456 - DNA, 27 bp; single-stranded, linear
  The letter "N" represents the stem II region of an HH ribozyme.
ugacgaugcugaugangaaacaaguag

SEQ ID NO: 3457 - DNA, 27 bp; single-stranded, linear
  The letter "N" represents the stem II region of an HH ribozyme.
uccaugaccugaugangaaauggacaa

SEQ ID NO: 3458 - DNA, 27 bp; single-stranded, linear
  The letter "N" represents the stem II region of an HH ribozyme.
ggauccaucugaugangaaacgaugga

SEQ ID NO: 3459 - DNA, 27 bp; single-stranded, linear
  The letter "N" represents the stem II region of an HH ribozyme.
uucaucugcugaugangaaauccauga

SEQ ID NO: 3460 - DNA, 27 bp; single-stranded, linear
  The letter "N" represents the stem II region of an HH ribozyme.
uccaauggcugaugangaaaguucauc

SEQ ID NO: 3461 - DNA, 27 bp; single-stranded, linear
  The letter "N" represents the stem II region of an HH ribozyme.
guucaucccugaugangaaaugggagu

SEQ ID NO: 3462 - DNA, 27 bp; single-stranded, linear
  The letter "N" represents the stem II region of an HH ribozyme.
ucguucaccugaugangaaauguucau

SEQ ID NO: 3463 - DNA, 27 bp; single-stranded, linear
  The letter "N" represents the stem II region of an HH ribozyme.
ggcaucaucugaugangaaaggcaguc

SEQ ID NO: 3464 - DNA, 27 bp; single-stranded, linear
  The letter "N" represents the stem II region of an HH ribozyme.
uggcaucacugaugangaaaaggcagu

SEQ ID NO: 3465 - DNA, 27 bp; single-stranded, linear
  The letter "N" represents the stem II region of an HH ribozyme.
cucuggggcugaugangaaauucccau

SEQ ID NO: 3466 - DNA, 27 bp; single-stranded, linear
  The letter "N" represents the stem II region of an HH ribozyme.
ucucugggcugaugangaaaauuccca

SEQ ID NO: 3467 - DNA, 27 bp; single-stranded, linear
  The letter "N" represents the stem II region of an HH ribozyme.
ggcuuacccugaugangaaagguucag

SEQ ID NO: 3468 - DNA, 27 bp; single-stranded, linear
  The letter "N" represents the stem II region of an HH ribozyme.
aagaggcucugaugangaaaccuaggu

SEQ ID NO: 3469 - DNA, 27 bp; single-stranded, linear
  The letter "N" represents the stem II region of an HH ribozyme.
acggccaacugaugangaaaggcuuac

SEQ ID NO: 3470 - DNA, 27 bp; single-stranded, linear
  The letter "N" represents the stem II region of an HH ribozyme.
ccacggcccugaugangaaagaggcuu

SEQ ID NO: 3471 - DNA, 27 bp; single-stranded, linear
  The letter "N" represents the stem II region of an HH ribozyme.
cuuggccacugaugangaaaggcacca

SEQ ID NO: 3472 - DNA, 27 bp; single-stranded, linear
  The letter "N" represents the stem II region of an HH ribozyme.
ucuuggcccugaugangaaaaggcacc

SEQ ID NO: 3473 - DNA, 27 bp; single-stranded, linear
  The letter "N" represents the stem II region of an HH ribozyme.
ucugcuuccugaugangaaaucucuug

SEQ ID NO: 3474 - DNA, 27 bp; single-stranded, linear
  The letter "N" represents the stem II region of an HH ribozyme.
caauuccacugaugangaaaggcaucu

SEQ ID NO: 3475 - DNA, 27 bp; single-stranded, linear
  The letter "N" represents the stem II region of an HH ribozyme.
ucaauucccugaugangaaaaggcauc

SEQ ID NO: 3476 - DNA, 27 bp; single-stranded, linear
  The letter "N" represents the stem II region of an HH ribozyme.
gucuuguccugaugangaaauuccaaa

SEQ ID NO: 3477 - DNA, 27 bp; single-stranded, linear
  The letter "N" represents the stem II region of an HH ribozyme.
uguccugccugaugangaaaguugcug

SEQ ID NO: 3478 - DNA, 27 bp; single-stranded, linear
  The letter "N" represents the stem II region of an HH ribozyme.
uugacugccugaugangaaacuguccu

SEQ ID NO: 3479 - DNA, 27 bp; single-stranded, linear
  The letter "N" represents the stem II region of an HH ribozyme.
aacauuuucugaugangaaacugcuac

SEQ ID NO: 3480 - DNA, 27 bp; single-stranded, linear
  The letter "N" represents the stem II region of an HH ribozyme.
cuucuuuccugaugangaaacauuuug

SEQ ID NO: 3481 - DNA, 27 bp; single-stranded, linear
  The letter "N" represents the stem II region of an HH ribozyme.
gagagcuccugaugangaaaugcucac

SEQ ID NO: 3482 - DNA, 27 bp; single-stranded, linear
  The letter "N" represents the stem II region of an HH ribozyme.
agacaugacugaugangaaagcucgau

SEQ ID NO: 3483 - DNA, 27 bp; single-stranded, linear
  The letter "N" represents the stem II region of an HH ribozyme.
ucagacaucugaugangaaagagcucg

SEQ ID NO: 3484 - DNA, 27 bp; single-stranded, linear
  The letter "N" represents the stem II region of an HH ribozyme.
ugaguucacugaugangaaacaugaga

SEQ ID NO: 3485 - DNA, 27 bp; single-stranded, linear
  The letter "N" represents the stem II region of an HH ribozyme.
aggaucuucugaugangaaaguucaga

SEQ ID NO: 3486 - DNA, 27 bp; single-stranded, linear
  The letter "N" represents the stem II region of an HH ribozyme.
ugaaugagcugaugangaaaucuugag

SEQ ID NO: 3487 - DNA, 27 bp; single-stranded, linear
  The letter "N" represents the stem II region of an HH ribozyme.
auaugaaucugaugangaaaggaucuu

SEQ ID NO: 3488 - DNA, 27 bp; single-stranded, linear
  The letter "N" represents the stem II region of an HH ribozyme.
ccaauaugcugaugangaaaugaggau

SEQ ID NO: 3489 - DNA, 27 bp; single-stranded, linear
  The letter "N" represents the stem II region of an HH ribozyme.
accaauaucugaugangaaaaugagga

SEQ ID NO: 3490 - DNA, 27 bp; single-stranded, linear
  The letter "N" represents the stem II region of an HH ribozyme.
gugaccaacugaugangaaaugaauga

SEQ ID NO: 3491 - DNA, 27 bp; single-stranded, linear
  The letter "N" represents the stem II region of an HH ribozyme.
uggugacccugaugangaaauaugaau

SEQ ID NO: 3492 - DNA, 27 bp; single-stranded, linear
  The letter "N" represents the stem II region of an HH ribozyme.
gagauggucugaugangaaaccaauau

SEQ ID NO: 3493 - DNA, 27 bp; single-stranded, linear
  The letter "N" represents the stem II region of an HH ribozyme.
cacauugacugaugangaaauggugac

SEQ ID NO: 3494 - DNA, 27 bp; single-stranded, linear
  The letter "N" represents the stem II region of an HH ribozyme.
accacauucugaugangaaagauggug

SEQ ID NO: 3495 - DNA, 27 bp; single-stranded, linear
  The letter "N" represents the stem II region of an HH ribozyme.
agaagguucugaugangaaaccacauu

SEQ ID NO: 3496 - DNA, 27 bp; single-stranded, linear
  The letter "N" represents the stem II region of an HH ribozyme.
gcaccuagcugaugangaaagguugac

SEQ ID NO: 3497 - DNA, 27 bp; single-stranded, linear
  The letter "N" represents the stem II region of an HH ribozyme.
ggcaccuacugaugangaaaagguuga

SEQ ID NO: 3498 - DNA, 27 bp; single-stranded, linear
  The letter "N" represents the stem II region of an HH ribozyme.
caggcacccugaugangaaagaagguu

SEQ ID NO: 3499 - DNA, 27 bp; single-stranded, linear
  The letter "N" represents the stem II region of an HH ribozyme.
uggcuuggcugaugangaaacaggcac

SEQ ID NO: 3500 - DNA, 27 bp; single-stranded, linear
  The letter "N" represents the stem II region of an HH ribozyme.
aucaccaucugaugangaaaguggccc

SEQ ID NO: 3501 - DNA, 27 bp; single-stranded, linear
  The letter "N" represents the stem II region of an HH ribozyme.
aauuccaccugaugangaaaucaccau

SEQ ID NO: 3502 - DNA, 27 bp; single-stranded, linear
  The letter "N" represents the stem II region of an HH ribozyme.
auuugcagcugaugangaaauuccaca

SEQ ID NO: 3503 - DNA, 27 bp; single-stranded, linear
  The letter "N" represents the stem II region of an HH ribozyme.
aauuugcacugaugangaaaauuccac

SEQ ID NO: 3504 - DNA, 27 bp; single-stranded, linear
  The letter "N" represents the stem II region of an HH ribozyme.
gguuuccacugaugangaaauuugcag

SEQ ID NO: 3505 - DNA, 27 bp; single-stranded, linear
  The letter "N" represents the stem II region of an HH ribozyme.
agguuucccugaugangaaaauuugca

SEQ ID NO: 3506 - DNA, 27 bp; single-stranded, linear
  The letter "N" represents the stem II region of an HH ribozyme.
gguaagugcugaugangaaacagguuu

SEQ ID NO: 3507 - DNA, 27 bp; single-stranded, linear
  The letter "N" represents the stem II region of an HH ribozyme.
ccucaggucugaugangaaaguggaca

SEQ ID NO: 3508 - DNA, 27 bp; single-stranded, linear
  The letter "N" represents the stem II region of an HH ribozyme.
uccucaggcugaugangaaaaguggac

SEQ ID NO: 3509 - DNA, 27 bp; single-stranded, linear
  The letter "N" represents the stem II region of an HH ribozyme.
aggggacacugaugangaaauucauuu

SEQ ID NO: 3510 - DNA, 27 bp; single-stranded, linear
  The letter "N" represents the stem II region of an HH ribozyme.
uaggggaccugaugangaaaauucauu

SEQ ID NO: 3511 - DNA, 27 bp; single-stranded, linear
  The letter "N" represents the stem II region of an HH ribozyme.
uuguagggcugaugangaaacaaauuc

SEQ ID NO: 3512 - DNA, 27 bp; single-stranded, linear
  The letter "N" represents the stem II region of an HH ribozyme.
uggucuugcugaugangaaaggggaca

SEQ ID NO: 3513 - DNA, 27 bp; single-stranded, linear
  The letter "N" represents the stem II region of an HH ribozyme.
cuugacggcugaugangaaaucgugcc

SEQ ID NO: 3514 - DNA, 27 bp; single-stranded, linear
  The letter "N" represents the stem II region of an HH ribozyme.
ccuugacgcugaugangaaaaucgugc

SEQ ID NO: 3515 - DNA, 27 bp; single-stranded, linear
  The letter "N" represents the stem II region of an HH ribozyme.
uuucccuucugaugangaaacggaauc

SEQ ID NO: 3516 - DNA, 27 bp; single-stranded, linear
  The letter "N" represents the stem II region of an HH ribozyme.
cuccaacgcugaugangaaagucuuuc

SEQ ID NO: 3517 - DNA, 27 bp; single-stranded, linear
  The letter "N" represents the stem II region of an HH ribozyme.
auugcucccugaugangaaacguaguc

SEQ ID NO: 3518 - DNA, 27 bp; single-stranded, linear
  The letter "N" represents the stem II region of an HH ribozyme.
uccacaggcugaugangaaauugcucc

SEQ ID NO: 3519 - DNA, 27 bp; single-stranded, linear
  The letter "N" represents the stem II region of an HH ribozyme.
ccguuucacugaugangaaauccacag

SEQ ID NO: 3520 - DNA, 27 bp; single-stranded, linear
  The letter "N" represents the stem II region of an HH ribozyme.
ugcugucccugaugangaaagcgccgu

SEQ ID NO: 3521 - DNA, 27 bp; single-stranded, linear
  The letter "N" represents the stem II region of an HH ribozyme.
cuacuggucugaugangaaaugcuguc

SEQ ID NO: 3522 - DNA, 27 bp; single-stranded, linear
  The letter "N" represents the stem II region of an HH ribozyme.
gcucuggccugaugangaaacugguga

SEQ ID NO: 3523 - DNA, 27 bp; single-stranded, linear
  The letter "N" represents the stem II region of an HH ribozyme.
agcuggcucugaugangaaagcucugg

SEQ ID NO: 3524 - DNA, 27 bp; single-stranded, linear
  The letter "N" represents the stem II region of an HH ribozyme.
caaauccacugaugangaaagcuggcu

SEQ ID NO: 3525 - DNA, 27 bp; single-stranded, linear
  The letter "N" represents the stem II region of an HH ribozyme.
ccuccacacugaugangaaauccagag

SEQ ID NO: 3526 - DNA, 27 bp; single-stranded, linear
  The letter "N" represents the stem II region of an HH ribozyme.
uccuccaccugaugangaaaauccaga

SEQ ID NO: 3527 - DNA, 27 bp; single-stranded, linear
  The letter "N" represents the stem II region of an HH ribozyme.
cacugaggcugaugangaaacuucucc

SEQ ID NO: 3528 - DNA, 27 bp; single-stranded, linear
  The letter "N" represents the stem II region of an HH ribozyme.
acaucacucugaugangaaagggacuu

SEQ ID NO: 3529 - DNA, 27 bp; single-stranded, linear
  The letter "N" represents the stem II region of an HH ribozyme.
ucuucuuccugaugangaaacaucacu

SEQ ID NO: 3530 - DNA, 27 bp; single-stranded, linear
  The letter "N" represents the stem II region of an HH ribozyme.
aucuucagcugaugangaaagcuuccu

SEQ ID NO: 3531 - DNA, 27 bp; single-stranded, linear
  The letter "N" represents the stem II region of an HH ribozyme.
cuuauacacugaugangaaaucuucag

SEQ ID NO: 3532 - DNA, 27 bp; single-stranded, linear
  The letter "N" represents the stem II region of an HH ribozyme.
aguccuuacugaugangaaacagaucu

SEQ ID NO: 3533 - DNA, 27 bp; single-stranded, linear
  The letter "N" represents the stem II region of an HH ribozyme.
gaaguccucugaugangaaauacagau

SEQ ID NO: 3534 - DNA, 27 bp; single-stranded, linear
  The letter "N" represents the stem II region of an HH ribozyme.
aggucaggcugaugangaaaguccuua

SEQ ID NO: 3535 - DNA, 27 bp; single-stranded, linear
  The letter "N" represents the stem II region of an HH ribozyme.
aaggucagcugaugangaaaaguccuu

SEQ ID NO: 3536 - DNA, 27 bp; single-stranded, linear
  The letter "N" represents the stem II region of an HH ribozyme.
gaugcucccugaugangaaaggucagg

SEQ ID NO: 3537 - DNA, 27 bp; single-stranded, linear
  The letter "N" represents the stem II region of an HH ribozyme.
acagaugacugaugangaaaugcucca

SEQ ID NO: 3538 - DNA, 27 bp; single-stranded, linear
  The letter "N" represents the stem II region of an HH ribozyme.
uaacagaucugaugangaaagaugcuc

SEQ ID NO: 3539 - DNA, 27 bp; single-stranded, linear
  The letter "N" represents the stem II region of an HH ribozyme.
cuguaacacugaugangaaaugagaug

SEQ ID NO: 3540 - DNA, 27 bp; single-stranded, linear
  The letter "N" represents the stem II region of an HH ribozyme.
gaagcugucugaugangaaacagauga

SEQ ID NO: 3541 - DNA, 27 bp; single-stranded, linear
  The letter "N" represents the stem II region of an HH ribozyme.
ggaagcugcugaugangaaaacagaug

SEQ ID NO: 3542 - DNA, 27 bp; single-stranded, linear
  The letter "N" represents the stem II region of an HH ribozyme.
ccacuuggcugaugangaaagcuguaa

SEQ ID NO: 3543 - DNA, 27 bp; single-stranded, linear
  The letter "N" represents the stem II region of an HH ribozyme.
gccacuugcugaugangaaaagcugua

SEQ ID NO: 3544 - DNA, 27 bp; single-stranded, linear
  The letter "N" represents the stem II region of an HH ribozyme.
caugcccucugaugangaaagccacuu

SEQ ID NO: 3545 - DNA, 27 bp; single-stranded, linear
  The letter "N" represents the stem II region of an HH ribozyme.
augccaagcugaugangaaacuccaug

SEQ ID NO: 3546 - DNA, 27 bp; single-stranded, linear
  The letter "N" represents the stem II region of an HH ribozyme.
gaugccaacugaugangaaaacuccau

SEQ ID NO: 3547 - DNA, 27 bp; single-stranded, linear
  The letter "N" represents the stem II region of an HH ribozyme.
gcgaugcccugaugangaaagaacucc

SEQ ID NO: 3548 - DNA, 27 bp; single-stranded, linear
  The letter "N" represents the stem II region of an HH ribozyme.
acuuucgccugaugangaaaugccaag

SEQ ID NO: 3549 - DNA, 27 bp; single-stranded, linear
  The letter "N" represents the stem II region of an HH ribozyme.
ccuguggacugaugangaaacacuuuc

SEQ ID NO: 3550 - DNA, 27 bp; single-stranded, linear
  The letter "N" represents the stem II region of an HH ribozyme.
ucccugugcugaugangaaauacacuu

SEQ ID NO: 3551 - DNA, 27 bp; single-stranded, linear
  The letter "N" represents the stem II region of an HH ribozyme.
uaagaggacugaugangaaauuucgug

SEQ ID NO: 3552 - DNA, 27 bp; single-stranded, linear
  The letter "N" represents the stem II region of an HH ribozyme.
gauaagagcugaugangaaauauuucg

SEQ ID NO: 3553 - DNA, 27 bp; single-stranded, linear
  The letter "N" represents the stem II region of an HH ribozyme.
uccgauaacugaugangaaaggauauu

SEQ ID NO: 3554 - DNA, 27 bp; single-stranded, linear
  The letter "N" represents the stem II region of an HH ribozyme.
ucuccgaucugaugangaaagaggaua

SEQ ID NO: 3555 - DNA, 27 bp; single-stranded, linear
  The letter "N" represents the stem II region of an HH ribozyme.
uucuccgacugaugangaaaagaggau

SEQ ID NO: 3556 - DNA, 27 bp; single-stranded, linear
  The letter "N" represents the stem II region of an HH ribozyme.
ucuucucccugaugangaaauaagagg

SEQ ID NO: 3557 - DNA, 27 bp; single-stranded, linear
  The letter "N" represents the stem II region of an HH ribozyme.
cagauuuucugaugangaaaccacguu

SEQ ID NO: 3558 - DNA, 27 bp; single-stranded, linear
  The letter "N" represents the stem II region of an HH ribozyme.
acagauuucugaugangaaaaccacgu

SEQ ID NO: 3559 - DNA, 27 bp; single-stranded, linear
  The letter "N" represents the stem II region of an HH ribozyme.
aagucacacugaugangaaauuuuaac

SEQ ID NO: 3560 - DNA, 27 bp; single-stranded, linear
  The letter "N" represents the stem II region of an HH ribozyme.
ccaagccacugaugangaaagucacag

SEQ ID NO: 3561 - DNA, 27 bp; single-stranded, linear
  The letter "N" represents the stem II region of an HH ribozyme.
gccaagcccugaugangaaaagucaca

SEQ ID NO: 3562 - DNA, 27 bp; single-stranded, linear
  The letter "N" represents the stem II region of an HH ribozyme.
cccgggcccugaugangaaagccaaag

SEQ ID NO: 3563 - DNA, 27 bp; single-stranded, linear
  The letter "N" represents the stem II region of an HH ribozyme.
uuuauaaacugaugangaaaucccggg

SEQ ID NO: 3564 - DNA, 27 bp; single-stranded, linear
  The letter "N" represents the stem II region of an HH ribozyme.
ucuuuauacugaugangaaauaucccg

SEQ ID NO: 3565 - DNA, 27 bp; single-stranded, linear
  The letter "N" represents the stem II region of an HH ribozyme.
aucuuuaucugaugangaaaauauccc

SEQ ID NO: 3566 - DNA, 27 bp; single-stranded, linear
  The letter "N" represents the stem II region of an HH ribozyme.
gaucuuuacugaugangaaaaauaucc

SEQ ID NO: 3567 - DNA, 27 bp; single-stranded, linear
  The letter "N" represents the stem II region of an HH ribozyme.
uggaucuucugaugangaaauaaauau

SEQ ID NO: 3568 - DNA, 27 bp; single-stranded, linear
  The letter "N" represents the stem II region of an HH ribozyme.
auaaucugcugaugangaaaucuuuau

SEQ ID NO: 3569 - DNA, 27 bp; single-stranded, linear
  The letter "N" represents the stem II region of an HH ribozyme.
ucugacaucugaugangaaaucuggau

SEQ ID NO: 3570 - DNA, 27 bp; single-stranded, linear
  The letter "N" represents the stem II region of an HH ribozyme.
uucugacacugaugangaaaaucugga

SEQ ID NO: 3571 - DNA, 27 bp; single-stranded, linear
  The letter "N" represents the stem II region of an HH ribozyme.
ccuuuucucugaugangaaacauaauc

SEQ ID NO: 3572 - DNA, 27 bp; single-stranded, linear
  The letter "N" represents the stem II region of an HH ribozyme.
agggaggccugaugangaaagcaucuc

SEQ ID NO: 3573 - DNA, 27 bp; single-stranded, linear
  The letter "N" represents the stem II region of an HH ribozyme.
uucaaaggcugaugangaaaggcgagc

SEQ ID NO: 3574 - DNA, 27 bp; single-stranded, linear
  The letter "N" represents the stem II region of an HH ribozyme.
ccauuucacugaugangaaagggaggc

SEQ ID NO: 3575 - DNA, 27 bp; single-stranded, linear
  The letter "N" represents the stem II region of an HH ribozyme.
uccauuuccugaugangaaaagggagg

SEQ ID NO: 3576 - DNA, 27 bp; single-stranded, linear
  The letter "N" represents the stem II region of an HH ribozyme.
cugucaaacugaugangaaauuguuuc

SEQ ID NO: 3577 - DNA, 27 bp; single-stranded, linear
  The letter "N" represents the stem II region of an HH ribozyme.
ucugucaacugaugangaaaauuguuu

SEQ ID NO: 3578 - DNA, 27 bp; single-stranded, linear
  The letter "N" represents the stem II region of an HH ribozyme.
cucugucacugaugangaaaaauuguu

SEQ ID NO: 3579 - DNA, 27 bp; single-stranded, linear
  The letter "N" represents the stem II region of an HH ribozyme.
acucuguccugaugangaaaaaauugu

SEQ ID NO: 3580 - DNA, 27 bp; single-stranded, linear
  The letter "N" represents the stem II region of an HH ribozyme.
ggauugugcugaugangaaacacucug

SEQ ID NO: 3581 - DNA, 27 bp; single-stranded, linear
  The letter "N" represents the stem II region of an HH ribozyme.
ucacucugcugaugangaaauugugua

SEQ ID NO: 3582 - DNA, 27 bp; single-stranded, linear
  The letter "N" represents the stem II region of an HH ribozyme.
aaagaccacugaugangaaacgucacu

SEQ ID NO: 3583 - DNA, 27 bp; single-stranded, linear
  The letter "N" represents the stem II region of an HH ribozyme.
caccaaaacugaugangaaaccagacg

SEQ ID NO: 3584 - DNA, 27 bp; single-stranded, linear
  The letter "N" represents the stem II region of an HH ribozyme.
aacaccaacugaugangaaagaccaga

SEQ ID NO: 3585 - DNA, 27 bp; single-stranded, linear
  The letter "N" represents the stem II region of an HH ribozyme.
aaacaccacugaugangaaaagaccag

SEQ ID NO: 3586 - DNA, 27 bp; single-stranded, linear
  The letter "N" represents the stem II region of an HH ribozyme.
aaaacacccugaugangaaaaagacca

SEQ ID NO: 3587 - DNA, 27 bp; single-stranded, linear
  The letter "N" represents the stem II region of an HH ribozyme.
cacagcaacugaugangaaacaccaaa

SEQ ID NO: 3588 - DNA, 27 bp; single-stranded, linear
  The letter "N" represents the stem II region of an HH ribozyme.
ccacagcacugaugangaaaacaccaa

SEQ ID NO: 3589 - DNA, 27 bp; single-stranded, linear
  The letter "N" represents the stem II region of an HH ribozyme.
cccacagccugaugangaaaaacacca

SEQ ID NO: 3590 - DNA, 27 bp; single-stranded, linear
  The letter "N" represents the stem II region of an HH ribozyme.
aaggaaaacugaugangaaauuuccca

SEQ ID NO: 3591 - DNA, 27 bp; single-stranded, linear
  The letter "N" represents the stem II region of an HH ribozyme.
cuaaggaacugaugangaaauauuucc

SEQ ID NO: 3592 - DNA, 27 bp; single-stranded, linear
  The letter "N" represents the stem II region of an HH ribozyme.
ccuaaggacugaugangaaaauauuuc

SEQ ID NO: 3593 - DNA, 27 bp; single-stranded, linear
  The letter "N" represents the stem II region of an HH ribozyme.
accuaaggcugaugangaaaaauauuu

SEQ ID NO: 3594 - DNA, 27 bp; single-stranded, linear
  The letter "N" represents the stem II region of an HH ribozyme.
caccuaagcugaugangaaaaaauauu

SEQ ID NO: 3595 - DNA, 27 bp; single-stranded, linear
  The letter "N" represents the stem II region of an HH ribozyme.
aagcaccucugaugangaaaggaaaau

SEQ ID NO: 3596 - DNA, 27 bp; single-stranded, linear
  The letter "N" represents the stem II region of an HH ribozyme.
gaagcacccugaugangaaaaggaaaa

SEQ ID NO: 3597 - DNA, 27 bp; single-stranded, linear
  The letter "N" represents the stem II region of an HH ribozyme.
auauggagcugaugangaaagcaccua

SEQ ID NO: 3598 - DNA, 27 bp; single-stranded, linear
  The letter "N" represents the stem II region of an HH ribozyme.
gauauggacugaugangaaaagcaccu

SEQ ID NO: 3599 - DNA, 27 bp; single-stranded, linear
  The letter "N" represents the stem II region of an HH ribozyme.
aggauaugcugaugangaaagaagcac

SEQ ID NO: 3600 - DNA, 27 bp; single-stranded, linear
  The letter "N" represents the stem II region of an HH ribozyme.
ccccaggacugaugangaaauggagaa

SEQ ID NO: 3601 - DNA, 27 bp; single-stranded, linear
  The letter "N" represents the stem II region of an HH ribozyme.
uaccccagcugaugangaaauauggag

SEQ ID NO: 3602 - DNA, 27 bp; single-stranded, linear
  The letter "N" represents the stem II region of an HH ribozyme.
ucaaucuucugaugangaaaccccagg

SEQ ID NO: 3603 - DNA, 27 bp; single-stranded, linear
  The letter "N" represents the stem II region of an HH ribozyme.
ucuucauccugaugangaaaucuuuac

SEQ ID NO: 3604 - DNA, 27 bp; single-stranded, linear
  The letter "N" represents the stem II region of an HH ribozyme.
gccuacaacugaugangaaauucuuca

SEQ ID NO: 3605 - DNA, 27 bp; single-stranded, linear
  The letter "N" represents the stem II region of an HH ribozyme.
cgccuacacugaugangaaaauucuuc

SEQ ID NO: 3606 - DNA, 27 bp; single-stranded, linear
  The letter "N" represents the stem II region of an HH ribozyme.
ucgccuaccugaugangaaaaauucuu

SEQ ID NO: 3607 - DNA, 27 bp; single-stranded, linear
  The letter "N" represents the stem II region of an HH ribozyme.
caaucgcccugaugangaaacaaaauu

SEQ ID NO: 3608 - DNA, 27 bp; single-stranded, linear
  The letter "N" represents the stem II region of an HH ribozyme.
cuucuuuccugaugangaaaucgccua

SEQ ID NO: 3609 - DNA, 27 bp; single-stranded, linear
  The letter "N" represents the stem II region of an HH ribozyme.
ccucauuccugaugangaaaguuccuu

SEQ ID NO: 3610 - DNA, 27 bp; single-stranded, linear
  The letter "N" represents the stem II region of an HH ribozyme.
uguaguaucugaugangaaaucagggg

SEQ ID NO: 3611 - DNA, 27 bp; single-stranded, linear
  The letter "N" represents the stem II region of an HH ribozyme.
guguaguacugaugangaaaaucaggg

SEQ ID NO: 3612 - DNA, 27 bp; single-stranded, linear
  The letter "N" represents the stem II region of an HH ribozyme.
ugguguagcugaugangaaauaaucag

SEQ ID NO: 3613 - DNA, 27 bp; single-stranded, linear
  The letter "N" represents the stem II region of an HH ribozyme.
uucuggugcugaugangaaaguauaau

SEQ ID NO: 3614 - DNA, 27 bp; single-stranded, linear
  The letter "N" represents the stem II region of an HH ribozyme.
uggucuggcugaugangaaacauuucu

SEQ ID NO: 3615 - DNA, 27 bp; single-stranded, linear
  The letter "N" represents the stem II region of an HH ribozyme.
gggucucucugaugangaaacugggcu

SEQ ID NO: 3616 - DNA, 27 bp; single-stranded, linear
  The letter "N" represents the stem II region of an HH ribozyme.
acucugaacugaugangaaacgugggu

SEQ ID NO: 3617 - DNA, 27 bp; single-stranded, linear
  The letter "N" represents the stem II region of an HH ribozyme.
aacucugacugaugangaaaacguggg

SEQ ID NO: 3618 - DNA, 27 bp; single-stranded, linear
  The letter "N" represents the stem II region of an HH ribozyme.
caacucugcugaugangaaaaacgugg

SEQ ID NO: 3619 - DNA, 27 bp; single-stranded, linear
  The letter "N" represents the stem II region of an HH ribozyme.
ccaacucucugaugangaaaaaacgug

SEQ ID NO: 3620 - DNA, 27 bp; single-stranded, linear
  The letter "N" represents the stem II region of an HH ribozyme.
guuccacccugaugangaaacucugaa

SEQ ID NO: 3621 - DNA, 27 bp; single-stranded, linear
  The letter "N" represents the stem II region of an HH ribozyme.
auuucccacugaugangaaauguucca

SEQ ID NO: 3622 - DNA, 27 bp; single-stranded, linear
  The letter "N" represents the stem II region of an HH ribozyme.
gauuuccccugaugangaaaauguucc

SEQ ID NO: 3623 - DNA, 27 bp; single-stranded, linear
  The letter "N" represents the stem II region of an HH ribozyme.
uugcaagacugaugangaaauuuccca

SEQ ID NO: 3624 - DNA, 27 bp; single-stranded, linear
  The letter "N" represents the stem II region of an HH ribozyme.
gcuugcaacugaugangaaagauuucc

SEQ ID NO: 3625 - DNA, 27 bp; single-stranded, linear
  The letter "N" represents the stem II region of an HH ribozyme.
uagcuugccugaugangaaagagauuu

SEQ ID NO: 3626 - DNA, 27 bp; single-stranded, linear
  The letter "N" represents the stem II region of an HH ribozyme.
cugagcaucugaugangaaagcuugca

SEQ ID NO: 3627 - DNA, 27 bp; single-stranded, linear
  The letter "N" represents the stem II region of an HH ribozyme.
auccugcucugaugangaaagcauuag

SEQ ID NO: 3628 - DNA, 27 bp; single-stranded, linear
  The letter "N" represents the stem II region of an HH ribozyme.
gaacaaugcugaugangaaagucuuug

SEQ ID NO: 3629 - DNA, 27 bp; single-stranded, linear
  The letter "N" represents the stem II region of an HH ribozyme.
ggaagaaccugaugangaaauguaguc

SEQ ID NO: 3630 - DNA, 27 bp; single-stranded, linear
  The letter "N" represents the stem II region of an HH ribozyme.
aucggaagcugaugangaaacaaugua

SEQ ID NO: 3631 - DNA, 27 bp; single-stranded, linear
  The letter "N" represents the stem II region of an HH ribozyme.
uaucggaacugaugangaaaacaaugu

SEQ ID NO: 3632 - DNA, 27 bp; single-stranded, linear
  The letter "N" represents the stem II region of an HH ribozyme.
gauaucggcugaugangaaagaacaau

SEQ ID NO: 3633 - DNA, 27 bp; single-stranded, linear
  The letter "N" represents the stem II region of an HH ribozyme.
ugauaucgcugaugangaaaagaacaa

SEQ ID NO: 3634 - DNA, 27 bp; single-stranded, linear
  The letter "N" represents the stem II region of an HH ribozyme.
gucucugacugaugangaaaucggaag

SEQ ID NO: 3635 - DNA, 27 bp; single-stranded, linear
  The letter "N" represents the stem II region of an HH ribozyme.
aagucucucugaugangaaauaucgga

SEQ ID NO: 3636 - DNA, 27 bp; single-stranded, linear
  The letter "N" represents the stem II region of an HH ribozyme.
caugcucacugaugangaaagucucug

SEQ ID NO: 3637 - DNA, 27 bp; single-stranded, linear
  The letter "N" represents the stem II region of an HH ribozyme.
ccaugcuccugaugangaaaagucucu

SEQ ID NO: 3638 - DNA, 27 bp; single-stranded, linear
  The letter "N" represents the stem II region of an HH ribozyme.
gaguccagcugaugangaaauccucuu

SEQ ID NO: 3639 - DNA, 27 bp; single-stranded, linear
  The letter "N" represents the stem II region of an HH ribozyme.
agaguccacugaugangaaaauccucu

SEQ ID NO: 3640 - DNA, 27 bp; single-stranded, linear
  The letter "N" represents the stem II region of an HH ribozyme.
ggcagagacugaugangaaaguccaga

SEQ ID NO: 3641 - DNA, 27 bp; single-stranded, linear
  The letter "N" represents the stem II region of an HH ribozyme.
uaggcagacugaugangaaagagucca

SEQ ID NO: 3642 - DNA, 27 bp; single-stranded, linear
  The letter "N" represents the stem II region of an HH ribozyme.
gguaggcacugaugangaaagagaguc

SEQ ID NO: 3643 - DNA, 27 bp; single-stranded, linear
  The letter "N" represents the stem II region of an HH ribozyme.
aggugaggcugaugangaaaggcagag

SEQ ID NO: 3644 - DNA, 27 bp; single-stranded, linear
  The letter "N" represents the stem II region of an HH ribozyme.
aaacaggucugaugangaaagguaggc

SEQ ID NO: 3645 - DNA, 27 bp; single-stranded, linear
  The letter "N" represents the stem II region of an HH ribozyme.
auacaggacugaugangaaacagguga

SEQ ID NO: 3646 - DNA, 27 bp; single-stranded, linear
  The letter "N" represents the stem II region of an HH ribozyme.
cauacaggcugaugangaaaacaggug

SEQ ID NO: 3647 - DNA, 27 bp; single-stranded, linear
  The letter "N" represents the stem II region of an HH ribozyme.
ccauacagcugaugangaaaaacaggu

SEQ ID NO: 3648 - DNA, 27 bp; single-stranded, linear
  The letter "N" represents the stem II region of an HH ribozyme.
cuccuccacugaugangaaacaggaaa

SEQ ID NO: 3649 - DNA, 27 bp; single-stranded, linear
  The letter "N" represents the stem II region of an HH ribozyme.
gggucacacugaugangaaacuuccuc

SEQ ID NO: 3650 - DNA, 27 bp; single-stranded, linear
  The letter "N" represents the stem II region of an HH ribozyme.
cauaauggcugaugangaaauuugggg

SEQ ID NO: 3651 - DNA, 27 bp; single-stranded, linear
  The letter "N" represents the stem II region of an HH ribozyme.
ucauaaugcugaugangaaaauuuggg

SEQ ID NO: 3652 - DNA, 27 bp; single-stranded, linear
  The letter "N" represents the stem II region of an HH ribozyme.
guugucaucugaugangaaauggaauu

SEQ ID NO: 3653 - DNA, 27 bp; single-stranded, linear
  The letter "N" represents the stem II region of an HH ribozyme.
uguugucacugaugangaaaauggaau

SEQ ID NO: 3654 - DNA, 27 bp; single-stranded, linear
  The letter "N" represents the stem II region of an HH ribozyme.
uacugacucugaugangaaauuccugc

SEQ ID NO: 3655 - DNA, 27 bp; single-stranded, linear
  The letter "N" represents the stem II region of an HH ribozyme.
cagauacucugaugangaaacugauuc

SEQ ID NO: 3656 - DNA, 27 bp; single-stranded, linear
  The letter "N" represents the stem II region of an HH ribozyme.
ucugcagacugaugangaaacugacug

SEQ ID NO: 3657 - DNA, 27 bp; single-stranded, linear
  The letter "N" represents the stem II region of an HH ribozyme.
guucugcacugaugangaaauacugac

SEQ ID NO: 3658 - DNA, 27 bp; single-stranded, linear
  The letter "N" represents the stem II region of an HH ribozyme.
cuuucgcucugaugangaaacuguucu

SEQ ID NO: 3659 - DNA, 27 bp; single-stranded, linear
  The letter "N" represents the stem II region of an HH ribozyme.
aauguuuucugaugangaaacacucac

SEQ ID NO: 3660 - DNA, 27 bp; single-stranded, linear
  The letter "N" represents the stem II region of an HH ribozyme.
uaucuucacugaugangaaauguuuuu

SEQ ID NO: 3661 - DNA, 27 bp; single-stranded, linear
  The letter "N" represents the stem II region of an HH ribozyme.
auaucuuccugaugangaaaauguuuu

SEQ ID NO: 3662 - DNA, 27 bp; single-stranded, linear
  The letter "N" represents the stem II region of an HH ribozyme.
uaacgggacugaugangaaaucuucaa

SEQ ID NO: 3663 - DNA, 27 bp; single-stranded, linear
  The letter "N" represents the stem II region of an HH ribozyme.
ucuaacggcugaugangaaauaucuuc

SEQ ID NO: 3664 - DNA, 27 bp; single-stranded, linear
  The letter "N" represents the stem II region of an HH ribozyme.
guucuucucugaugangaaacgggaua

SEQ ID NO: 3665 - DNA, 27 bp; single-stranded, linear
  The letter "N" represents the stem II region of an HH ribozyme.
gguucuuccugaugangaaaacgggau

SEQ ID NO: 3666 - DNA, 27 bp; single-stranded, linear
  The letter "N" represents the stem II region of an HH ribozyme.
auuacuuucugaugangaaacuucugg

SEQ ID NO: 3667 - DNA, 27 bp; single-stranded, linear
  The letter "N" represents the stem II region of an HH ribozyme.
ucugggaucugaugangaaacuuuuac

SEQ ID NO: 3668 - DNA, 27 bp; single-stranded, linear
  The letter "N" represents the stem II region of an HH ribozyme.
ucaucuggcugaugangaaauuacuuu

SEQ ID NO: 3669 - DNA, 27 bp; single-stranded, linear
  The letter "N" represents the stem II region of an HH ribozyme.
aagaaccacugaugangaaaccacugu

SEQ ID NO: 3670 - DNA, 27 bp; single-stranded, linear
  The letter "N" represents the stem II region of an HH ribozyme.
gaggcaagcugaugangaaaccauacc

SEQ ID NO: 3671 - DNA, 27 bp; single-stranded, linear
  The letter "N" represents the stem II region of an HH ribozyme.
ugaggcaacugaugangaaaaccauac

SEQ ID NO: 3672 - DNA, 27 bp; single-stranded, linear
  The letter "N" represents the stem II region of an HH ribozyme.
ucugaggccugaugangaaagaaccau

SEQ ID NO: 3673 - DNA, 27 bp; single-stranded, linear
  The letter "N" represents the stem II region of an HH ribozyme.
gcucuucucugaugangaaaggcaaga

SEQ ID NO: 3674 - DNA, 27 bp; single-stranded, linear
  The letter "N" represents the stem II region of an HH ribozyme.
gucuuccacugaugangaaaguuuuca

SEQ ID NO: 3675 - DNA, 27 bp; single-stranded, linear
  The letter "N" represents the stem II region of an HH ribozyme.
ugucuucccugaugangaaaaguuuuc

SEQ ID NO: 3676 - DNA, 27 bp; single-stranded, linear
  The letter "N" represents the stem II region of an HH ribozyme.
auggagaucugaugangaaauuugguu

SEQ ID NO: 3677 - DNA, 27 bp; single-stranded, linear
  The letter "N" represents the stem II region of an HH ribozyme.
gauggagacugaugangaaaauuuggu

SEQ ID NO: 3678 - DNA, 27 bp; single-stranded, linear
  The letter "N" represents the stem II region of an HH ribozyme.
aagauggacugaugangaaauaauuug

SEQ ID NO: 3679 - DNA, 27 bp; single-stranded, linear
  The letter "N" represents the stem II region of an HH ribozyme.
aaaagaugcugaugangaaagauaauu

SEQ ID NO: 3680 - DNA, 27 bp; single-stranded, linear
  The letter "N" represents the stem II region of an HH ribozyme.
caccaaaacugaugangaaauggagau

SEQ ID NO: 3681 - DNA, 27 bp; single-stranded, linear
  The letter "N" represents the stem II region of an HH ribozyme.
uccaccaacugaugangaaagauggag

SEQ ID NO: 3682 - DNA, 27 bp; single-stranded, linear
  The letter "N" represents the stem II region of an HH ribozyme.
uuccaccacugaugangaaaagaugga

SEQ ID NO: 3683 - DNA, 27 bp; single-stranded, linear
  The letter "N" represents the stem II region of an HH ribozyme.
auuccacccugaugangaaaaagaugg

SEQ ID NO: 3684 - DNA, 27 bp; single-stranded, linear
  The letter "N" represents the stem II region of an HH ribozyme.
augccacacugaugangaaacucccug

SEQ ID NO: 3685 - DNA, 27 bp; single-stranded, linear
  The letter "N" represents the stem II region of an HH ribozyme.
agccuucacugaugangaaaugccaca

SEQ ID NO: 3686 - DNA, 27 bp; single-stranded, linear
  The letter "N" represents the stem II region of an HH ribozyme.
ucugguuucugaugangaaagccuuca

SEQ ID NO: 3687 - DNA, 27 bp; single-stranded, linear
  The letter "N" represents the stem II region of an HH ribozyme.
cggacuggcugaugangaaagccgcuu

SEQ ID NO: 3688 - DNA, 27 bp; single-stranded, linear
  The letter "N" represents the stem II region of an HH ribozyme.
gauauccgcugaugangaaacugguag

SEQ ID NO: 3689 - DNA, 27 bp; single-stranded, linear
  The letter "N" represents the stem II region of an HH ribozyme.
cggagugacugaugangaaauccggac

SEQ ID NO: 3690 - DNA, 27 bp; single-stranded, linear
  The letter "N" represents the stem II region of an HH ribozyme.
aucggagucugaugangaaauauccgg

SEQ ID NO: 3691 - DNA, 27 bp; single-stranded, linear
  The letter "N" represents the stem II region of an HH ribozyme.
ugucaucgcugaugangaaagugauau

SEQ ID NO: 3692 - DNA, 27 bp; single-stranded, linear
  The letter "N" represents the stem II region of an HH ribozyme.
cacuggagcugaugangaaacacggug

SEQ ID NO: 3693 - DNA, 27 bp; single-stranded, linear
  The letter "N" represents the stem II region of an HH ribozyme.
ccucacugcugaugangaaaguacacg

SEQ ID NO: 3694 - DNA, 27 bp; single-stranded, linear
  The letter "N" represents the stem II region of an HH ribozyme.
agcuuuaacugaugangaaaguucugc

SEQ ID NO: 3695 - DNA, 27 bp; single-stranded, linear
  The letter "N" represents the stem II region of an HH ribozyme.
cagcuuuacugaugangaaaaguucug

SEQ ID NO: 3696 - DNA, 27 bp; single-stranded, linear
  The letter "N" represents the stem II region of an HH ribozyme.
ucagcuuucugaugangaaaaaguucu

SEQ ID NO: 3697 - DNA, 27 bp; single-stranded, linear
  The letter "N" represents the stem II region of an HH ribozyme.
aucagcuucugaugangaaaaaaguuc

SEQ ID NO: 3698 - DNA, 27 bp; single-stranded, linear
  The letter "N" represents the stem II region of an HH ribozyme.
ccaaucuccugaugangaaaucagcuu

SEQ ID NO: 3699 - DNA, 27 bp; single-stranded, linear
  The letter "N" represents the stem II region of an HH ribozyme.
ugcacucccugaugangaaaucucuau

SEQ ID NO: 3700 - DNA, 27 bp; single-stranded, linear
  The letter "N" represents the stem II region of an HH ribozyme.
ggcugugccugaugangaaaccgguuu

SEQ ID NO: 3701 - DNA, 27 bp; single-stranded, linear
  The letter "N" represents the stem II region of an HH ribozyme.
ggcuggagcugaugangaaaucugggc

SEQ ID NO: 3702 - DNA, 27 bp; single-stranded, linear
  The letter "N" represents the stem II region of an HH ribozyme.
aggcuggacugaugangaaaaucuggg

SEQ ID NO: 3703 - DNA, 27 bp; single-stranded, linear
  The letter "N" represents the stem II region of an HH ribozyme.
ucaggcugcugaugangaaagaaucug

SEQ ID NO: 3704 - DNA, 27 bp; single-stranded, linear
  The letter "N" represents the stem II region of an HH ribozyme.
caggaggacugaugangaaagcucagu

SEQ ID NO: 3705 - DNA, 27 bp; single-stranded, linear
  The letter "N" represents the stem II region of an HH ribozyme.
aacaggagcugaugangaaagagcuca

SEQ ID NO: 3706 - DNA, 27 bp; single-stranded, linear
  The letter "N" represents the stem II region of an HH ribozyme.
uuaaacagcugaugangaaaggagagc

SEQ ID NO: 3707 - DNA, 27 bp; single-stranded, linear
  The letter "N" represents the stem II region of an HH ribozyme.
uccuuuuacugaugangaaacaggagg

SEQ ID NO: 3708 - DNA, 27 bp; single-stranded, linear
  The letter "N" represents the stem II region of an HH ribozyme.
uuccuuuucugaugangaaaacaggag

SEQ ID NO: 3709 - DNA, 27 bp; single-stranded, linear
  The letter "N" represents the stem II region of an HH ribozyme.
cuuccuuucugaugangaaaaacagga

SEQ ID NO: 3710 - DNA, 27 bp; single-stranded, linear
  The letter "N" represents the stem II region of an HH ribozyme.
ggggugugcugaugangaaaugcuucc

SEQ ID NO: 3711 - DNA, 27 bp; single-stranded, linear
  The letter "N" represents the stem II region of an HH ribozyme.
auguccggcugaugangaaaguugggg

SEQ ID NO: 3712 - DNA, 27 bp; single-stranded, linear
  The letter "N" represents the stem II region of an HH ribozyme.
ucucaugucugaugangaaauguccgg

SEQ ID NO: 3713 - DNA, 27 bp; single-stranded, linear
  The letter "N" represents the stem II region of an HH ribozyme.
ucugagcacugaugangaaaccucuca

SEQ ID NO: 3714 - DNA, 27 bp; single-stranded, linear
  The letter "N" represents the stem II region of an HH ribozyme.
caaaaucucugaugangaaagcagacc

SEQ ID NO: 3715 - DNA, 27 bp; single-stranded, linear
  The letter "N" represents the stem II region of an HH ribozyme.
cacuucaacugaugangaaaucugagc

SEQ ID NO: 3716 - DNA, 27 bp; single-stranded, linear
  The letter "N" represents the stem II region of an HH ribozyme.
acacuucacugaugangaaaaucugag

SEQ ID NO: 3717 - DNA, 27 bp; single-stranded, linear
  The letter "N" represents the stem II region of an HH ribozyme.
aacacuuccugaugangaaaaaucuga

SEQ ID NO: 3718 - DNA, 27 bp; single-stranded, linear
  The letter "N" represents the stem II region of an HH ribozyme.
gaaagaaccugaugangaaacacuuca

SEQ ID NO: 3719 - DNA, 27 bp; single-stranded, linear
  The letter "N" represents the stem II region of an HH ribozyme.
guggaaagcugaugangaaacaacacu

SEQ ID NO: 3720 - DNA, 27 bp; single-stranded, linear
  The letter "N" represents the stem II region of an HH ribozyme.
gguggaaacugaugangaaaacaacac

SEQ ID NO: 3721 - DNA, 27 bp; single-stranded, linear
  The letter "N" represents the stem II region of an HH ribozyme.
cugguggacugaugangaaagaacaac

SEQ ID NO: 3722 - DNA, 27 bp; single-stranded, linear
  The letter "N" represents the stem II region of an HH ribozyme.
gcugguggcugaugangaaaagaacaa

SEQ ID NO: 3723 - DNA, 27 bp; single-stranded, linear
  The letter "N" represents the stem II region of an HH ribozyme.
ugcuggugcugaugangaaaaagaaca

SEQ ID NO: 3724 - DNA, 27 bp; single-stranded, linear
  The letter "N" represents the stem II region of an HH ribozyme.
aaugcggccugaugangaaacuuccug

SEQ ID NO: 3725 - DNA, 27 bp; single-stranded, linear
  The letter "N" represents the stem II region of an HH ribozyme.
gaaaaucacugaugangaaaugcggcu

SEQ ID NO: 3726 - DNA, 27 bp; single-stranded, linear
  The letter "N" represents the stem II region of an HH ribozyme.
ugaaaauccugaugangaaaaugcggc

SEQ ID NO: 3727 - DNA, 27 bp; single-stranded, linear
  The letter "N" represents the stem II region of an HH ribozyme.
gaaaugaacugaugangaaaucaaaug

SEQ ID NO: 3728 - DNA, 27 bp; single-stranded, linear
  The letter "N" represents the stem II region of an HH ribozyme.
cgaaaugacugaugangaaaaucaaau

SEQ ID NO: 3729 - DNA, 27 bp; single-stranded, linear
  The letter "N" represents the stem II region of an HH ribozyme.
ucgaaaugcugaugangaaaaaucaaa

SEQ ID NO: 3730 - DNA, 27 bp; single-stranded, linear
  The letter "N" represents the stem II region of an HH ribozyme.
gucgaaaucugaugangaaaaaaucaa

SEQ ID NO: 3731 - DNA, 27 bp; single-stranded, linear
  The letter "N" represents the stem II region of an HH ribozyme.
guugucgacugaugangaaaugaaaau

SEQ ID NO: 3732 - DNA, 27 bp; single-stranded, linear
  The letter "N" represents the stem II region of an HH ribozyme.
uguugucgcugaugangaaaaugaaaa

SEQ ID NO: 3733 - DNA, 27 bp; single-stranded, linear
  The letter "N" represents the stem II region of an HH ribozyme.
cuguuguccugaugangaaaaaugaaa

SEQ ID NO: 3734 - DNA, 27 bp; single-stranded, linear
  The letter "N" represents the stem II region of an HH ribozyme.
ugcagucccugaugangaaagguccuu

SEQ ID NO: 3735 - DNA, 27 bp; single-stranded, linear
  The letter "N" represents the stem II region of an HH ribozyme.
gccuagaacugaugangaaagcuggcu

SEQ ID NO: 3736 - DNA, 27 bp; single-stranded, linear
  The letter "N" represents the stem II region of an HH ribozyme.
aagccuagcugaugangaaagagcugg

SEQ ID NO: 3737 - DNA, 27 bp; single-stranded, linear
  The letter "N" represents the stem II region of an HH ribozyme.
caagccuacugaugangaaaagagcug

SEQ ID NO: 3738 - DNA, 27 bp; single-stranded, linear
  The letter "N" represents the stem II region of an HH ribozyme.
cacaagcccugaugangaaagaagagc

SEQ ID NO: 3739 - DNA, 17 bp; single-stranded, linear
cuggccgucgcccugug

SEQ ID NO: 3740 - DNA, 17 bp; single-stranded, linear
cuguggcucugcgugga

SEQ ID NO: 3741 - DNA, 17 bp; single-stranded, linear
ggccgccucuguggguu

SEQ ID NO: 3742 - DNA, 17 bp; single-stranded, linear
cuguggguuugccuagu

SEQ ID NO: 3743 - DNA, 17 bp; single-stranded, linear
uguggguuugccuagug

SEQ ID NO: 3744 - DNA, 17 bp; single-stranded, linear
guuugccuaguguuucu

SEQ ID NO: 3745 - DNA, 17 bp; single-stranded, linear
ccuaguguuucucuuga

SEQ ID NO: 3746 - DNA, 17 bp; single-stranded, linear
cuaguguuucucuugau

SEQ ID NO: 3747 - DNA, 17 bp; single-stranded, linear
uaguguuucucuugauc

SEQ ID NO: 3748 - DNA, 17 bp; single-stranded, linear
guguuucucuugaucug

SEQ ID NO: 3749 - DNA, 17 bp; single-stranded, linear
guuucucuugaucugcc

SEQ ID NO: 3750 - DNA, 17 bp; single-stranded, linear
cucuugaucugcccagg

SEQ ID NO: 3751 - DNA, 17 bp; single-stranded, linear
cccaggcucagcauaca

SEQ ID NO: 3752 - DNA, 17 bp; single-stranded, linear
cucagcauacaaaaaga

SEQ ID NO: 3753 - DNA, 17 bp; single-stranded, linear
aaagacauacuuacaau

SEQ ID NO: 3754 - DNA, 17 bp; single-stranded, linear
gacauacuuacaauuaa

SEQ ID NO: 3755 - DNA, 17 bp; single-stranded, linear
acauacuuacaauuaag

SEQ ID NO: 3756 - DNA, 17 bp; single-stranded, linear
cuuacaauuaaggcuaa

SEQ ID NO: 3757 - DNA, 17 bp; single-stranded, linear
uuacaauuaaggcuaau

SEQ ID NO: 3758 - DNA, 17 bp; single-stranded, linear
uuaaggcuaauacaacu

SEQ ID NO: 3759 - DNA, 17 bp; single-stranded, linear
aggcuaauacaacucuu

SEQ ID NO: 3760 - DNA, 17 bp; single-stranded, linear
auacaacucuucaaauu

SEQ ID NO: 3761 - DNA, 17 bp; single-stranded, linear
acaacucuucaaauuac

SEQ ID NO: 3762 - DNA, 17 bp; single-stranded, linear
caacucuucaaauuacu

SEQ ID NO: 3763 - DNA, 17 bp; single-stranded, linear
cuucaaauuacuugcag

SEQ ID NO: 3764 - DNA, 17 bp; single-stranded, linear
uucaaauuacuugcagg

SEQ ID NO: 3765 - DNA, 17 bp; single-stranded, linear
aaauuacuugcagggga

SEQ ID NO: 3766 - DNA, 17 bp; single-stranded, linear
gagggacuuggacuggc

SEQ ID NO: 3767 - DNA, 17 bp; single-stranded, linear
gacuggcuuuggcccaa

SEQ ID NO: 3768 - DNA, 17 bp; single-stranded, linear
acuggcuuuggcccaau

SEQ ID NO: 3769 - DNA, 17 bp; single-stranded, linear
ggcccaauaaucagagu

SEQ ID NO: 3770 - DNA, 17 bp; single-stranded, linear
ccaauaaucagaguggc

SEQ ID NO: 3771 - DNA, 17 bp; single-stranded, linear
gauggccucuucuguaa

SEQ ID NO: 3772 - DNA, 17 bp; single-stranded, linear
uggccucuucuguaaga

SEQ ID NO: 3773 - DNA, 17 bp; single-stranded, linear
ggccucuucuguaagac

SEQ ID NO: 3774 - DNA, 17 bp; single-stranded, linear
ucuucuguaagacacuc

SEQ ID NO: 3775 - DNA, 17 bp; single-stranded, linear
aagacacucacaauucc

SEQ ID NO: 3776 - DNA, 17 bp; single-stranded, linear
cucacaauuccaaaagu

SEQ ID NO: 3777 - DNA, 17 bp; single-stranded, linear
ucacaauuccaaaagug

SEQ ID NO: 3778 - DNA, 17 bp; single-stranded, linear
aaagugaucggaaauga

SEQ ID NO: 3779 - DNA, 17 bp; single-stranded, linear
uggagccuacaagugcu

SEQ ID NO: 3780 - DNA, 17 bp; single-stranded, linear
caagugcuucuaccggg

SEQ ID NO: 3781 - DNA, 17 bp; single-stranded, linear
aagugcuucuaccggga

SEQ ID NO: 3782 - DNA, 17 bp; single-stranded, linear
gugcuucuaccgggaaa

SEQ ID NO: 3783 - DNA, 17 bp; single-stranded, linear
aacugacuuggccucgg

SEQ ID NO: 3784 - DNA, 17 bp; single-stranded, linear
cuuggccucggucauuu

SEQ ID NO: 3785 - DNA, 17 bp; single-stranded, linear
gccucggucauuuaugu

SEQ ID NO: 3786 - DNA, 17 bp; single-stranded, linear
ucggucauuuaugucua

SEQ ID NO: 3787 - DNA, 17 bp; single-stranded, linear
cggucauuuaugucuau

SEQ ID NO: 3788 - DNA, 17 bp; single-stranded, linear
ggucauuuaugucuaug

SEQ ID NO: 3789 - DNA, 17 bp; single-stranded, linear
auuuaugucuauguuca

SEQ ID NO: 3790 - DNA, 17 bp; single-stranded, linear
uuaugucuauguucaag

SEQ ID NO: 3791 - DNA, 17 bp; single-stranded, linear
gucuauguucaagauua

SEQ ID NO: 3792 - DNA, 17 bp; single-stranded, linear
ucuauguucaagauuac

SEQ ID NO: 3793 - DNA, 17 bp; single-stranded, linear
uucaagauuacagaucu

SEQ ID NO: 3794 - DNA, 17 bp; single-stranded, linear
ucaagauuacagaucuc

SEQ ID NO: 3795 - DNA, 17 bp; single-stranded, linear
uuacagaucuccauuua

SEQ ID NO: 3796 - DNA, 17 bp; single-stranded, linear
acagaucuccauuuauu

SEQ ID NO: 3797 - DNA, 17 bp; single-stranded, linear
aucuccauuuauugcuu

SEQ ID NO: 3798 - DNA, 17 bp; single-stranded, linear
ucuccauuuauugcuuc

SEQ ID NO: 3799 - DNA, 17 bp; single-stranded, linear
cuccauuuauugcuucu

SEQ ID NO: 3800 - DNA, 17 bp; single-stranded, linear
ccauuuauugcuucugu

SEQ ID NO: 3801 - DNA, 17 bp; single-stranded, linear
uuauugcuucuguuagu

SEQ ID NO: 3802 - DNA, 17 bp; single-stranded, linear
uauugcuucuguuagug

SEQ ID NO: 3803 - DNA, 17 bp; single-stranded, linear
gcuucuguuagugacca

SEQ ID NO: 3804 - DNA, 17 bp; single-stranded, linear
cuucuguuagugaccaa

SEQ ID NO: 3805 - DNA, 17 bp; single-stranded, linear
cauggagucguguacau

SEQ ID NO: 3806 - DNA, 17 bp; single-stranded, linear
agucguguacauuacug

SEQ ID NO: 3807 - DNA, 17 bp; single-stranded, linear
guguacauuacugagaa

SEQ ID NO: 3808 - DNA, 17 bp; single-stranded, linear
uguacauuacugagaac

SEQ ID NO: 3809 - DNA, 17 bp; single-stranded, linear
guggugauuccaugucu

SEQ ID NO: 3810 - DNA, 17 bp; single-stranded, linear
uggugauuccaugucuc

SEQ ID NO: 3811 - DNA, 17 bp; single-stranded, linear
uuccaugucucgggucc

SEQ ID NO: 3812 - DNA, 17 bp; single-stranded, linear
ccaugucucggguccau

SEQ ID NO: 3813 - DNA, 17 bp; single-stranded, linear
ucucggguccauuucaa

SEQ ID NO: 3814 - DNA, 17 bp; single-stranded, linear
ggguccauuucaaaucu

SEQ ID NO: 3815 - DNA, 17 bp; single-stranded, linear
gguccauuucaaaucuc

SEQ ID NO: 3816 - DNA, 17 bp; single-stranded, linear
guccauuucaaaucuca

SEQ ID NO: 3817 - DNA, 17 bp; single-stranded, linear
uuucaaaucucaacgug

SEQ ID NO: 3818 - DNA, 17 bp; single-stranded, linear
ucaaaucucaacguguc

SEQ ID NO: 3819 - DNA, 17 bp; single-stranded, linear
caacgugucacuuugug

SEQ ID NO: 3820 - DNA, 17 bp; single-stranded, linear
gugucacuuugugcaag

SEQ ID NO: 3821 - DNA, 17 bp; single-stranded, linear
ugucacuuugugcaaga

SEQ ID NO: 3822 - DNA, 17 bp; single-stranded, linear
ugcaagauacccagaaa

SEQ ID NO: 3823 - DNA, 17 bp; single-stranded, linear
aaagagauuuguuccug

SEQ ID NO: 3824 - DNA, 17 bp; single-stranded, linear
aagagauuuguuccuga

SEQ ID NO: 3825 - DNA, 17 bp; single-stranded, linear
agauuuguuccugaugg

SEQ ID NO: 3826 - DNA, 17 bp; single-stranded, linear
gauuuguuccugauggu

SEQ ID NO: 3827 - DNA, 17 bp; single-stranded, linear
cugaugguaacagaauu

SEQ ID NO: 3828 - DNA, 17 bp; single-stranded, linear
aacagaauuuccuggga

SEQ ID NO: 3829 - DNA, 17 bp; single-stranded, linear
acagaauuuccugggac

SEQ ID NO: 3830 - DNA, 17 bp; single-stranded, linear
cagaauuuccugggaca

SEQ ID NO: 3831 - DNA, 17 bp; single-stranded, linear
gaagggcuuuacuauuc

SEQ ID NO: 3832 - DNA, 17 bp; single-stranded, linear
aagggcuuuacuauucc

SEQ ID NO: 3833 - DNA, 17 bp; single-stranded, linear
agggcuuuacuauuccc

SEQ ID NO: 3834 - DNA, 17 bp; single-stranded, linear
gcuuuacuauucccagc

SEQ ID NO: 3835 - DNA, 17 bp; single-stranded, linear
uuuacuauucccagcua

SEQ ID NO: 3836 - DNA, 17 bp; single-stranded, linear
uuacuauucccagcuac

SEQ ID NO: 3837 - DNA, 17 bp; single-stranded, linear
ucccagcuacaugauca

SEQ ID NO: 3838 - DNA, 17 bp; single-stranded, linear
uacaugaucagcuaugc

SEQ ID NO: 3839 - DNA, 17 bp; single-stranded, linear
gaucagcuaugcuggca

SEQ ID NO: 3840 - DNA, 17 bp; single-stranded, linear
ggcauggucuucuguga

SEQ ID NO: 3841 - DNA, 17 bp; single-stranded, linear
cauggucuucugugaag

SEQ ID NO: 3842 - DNA, 17 bp; single-stranded, linear
auggucuucugugaagc

SEQ ID NO: 3843 - DNA, 17 bp; single-stranded, linear
gcaaaaauuaaugauga

SEQ ID NO: 3844 - DNA, 17 bp; single-stranded, linear
caaaaauuaaugaugaa

SEQ ID NO: 3845 - DNA, 17 bp; single-stranded, linear
augaaaguuaccagucu

SEQ ID NO: 3846 - DNA, 17 bp; single-stranded, linear
ugaaaguuaccagucua

SEQ ID NO: 3847 - DNA, 17 bp; single-stranded, linear
uuaccagucuauuaugu

SEQ ID NO: 3848 - DNA, 17 bp; single-stranded, linear
accagucuauuauguac

SEQ ID NO: 3849 - DNA, 17 bp; single-stranded, linear
cagucuauuauguacau

SEQ ID NO: 3850 - DNA, 17 bp; single-stranded, linear
agucuauuauguacaua

SEQ ID NO: 3851 - DNA, 17 bp; single-stranded, linear
uauuauguacauaguug

SEQ ID NO: 3852 - DNA, 17 bp; single-stranded, linear
auguacauaguugucgu

SEQ ID NO: 3853 - DNA, 17 bp; single-stranded, linear
uacauaguugucguugu

SEQ ID NO: 3854 - DNA, 17 bp; single-stranded, linear
auaguugucguuguagg

SEQ ID NO: 3855 - DNA, 17 bp; single-stranded, linear
guugucguuguagggua

SEQ ID NO: 3856 - DNA, 17 bp; single-stranded, linear
gucguuguaggguauag

SEQ ID NO: 3857 - DNA, 17 bp; single-stranded, linear
uguaggguauaggauuu

SEQ ID NO: 3858 - DNA, 17 bp; single-stranded, linear
uaggguauaggauuuau

SEQ ID NO: 3859 - DNA, 17 bp; single-stranded, linear
uauaggauuuaugaugu

SEQ ID NO: 3860 - DNA, 17 bp; single-stranded, linear
auaggauuuaugaugug

SEQ ID NO: 3861 - DNA, 17 bp; single-stranded, linear
uaggauuuaugaugugg

SEQ ID NO: 3862 - DNA, 17 bp; single-stranded, linear
gaugugguucugagucc

SEQ ID NO: 3863 - DNA, 17 bp; single-stranded, linear
augugguucugaguccg

SEQ ID NO: 3864 - DNA, 17 bp; single-stranded, linear
uucugaguccgucucau

SEQ ID NO: 3865 - DNA, 17 bp; single-stranded, linear
gaguccgucucauggaa

SEQ ID NO: 3866 - DNA, 17 bp; single-stranded, linear
guccgucucauggaauu

SEQ ID NO: 3867 - DNA, 17 bp; single-stranded, linear
cauggaauugaacuauc

SEQ ID NO: 3868 - DNA, 17 bp; single-stranded, linear
auugaacuaucuguugg

SEQ ID NO: 3869 - DNA, 17 bp; single-stranded, linear
ugaacuaucuguuggag

SEQ ID NO: 3870 - DNA, 17 bp; single-stranded, linear
cuaucuguuggagaaaa

SEQ ID NO: 3871 - DNA, 17 bp; single-stranded, linear
gaaaagcuugucuuaaa

SEQ ID NO: 3872 - DNA, 17 bp; single-stranded, linear
aagcuugucuuaaauug

SEQ ID NO: 3873 - DNA, 17 bp; single-stranded, linear
gcuugucuuaaauugua

SEQ ID NO: 3874 - DNA, 17 bp; single-stranded, linear
cuugucuuaaauuguac

SEQ ID NO: 3875 - DNA, 17 bp; single-stranded, linear
ucuuaaauuguacagca

SEQ ID NO: 3876 - DNA, 17 bp; single-stranded, linear
uaaauuguacagcaaga

SEQ ID NO: 3877 - DNA, 17 bp; single-stranded, linear
acugaacuaaauguggg

SEQ ID NO: 3878 - DNA, 17 bp; single-stranded, linear
guggggauugacuucaa

SEQ ID NO: 3879 - DNA, 17 bp; single-stranded, linear
gauugacuucaacuggg

SEQ ID NO: 3880 - DNA, 17 bp; single-stranded, linear
auugacuucaacuggga

SEQ ID NO: 3881 - DNA, 17 bp; single-stranded, linear
cugggaauacccuucuu

SEQ ID NO: 3882 - DNA, 17 bp; single-stranded, linear
aauacccuucuucgaag

SEQ ID NO: 3883 - DNA, 17 bp; single-stranded, linear
auacccuucuucgaagc

SEQ ID NO: 3884 - DNA, 17 bp; single-stranded, linear
acccuucuucgaagcau

SEQ ID NO: 3885 - DNA, 17 bp; single-stranded, linear
cccuucuucgaagcauc

SEQ ID NO: 3886 - DNA, 17 bp; single-stranded, linear
cgaagcaucagcauaag

SEQ ID NO: 3887 - DNA, 17 bp; single-stranded, linear
aucagcauaagaaacuu

SEQ ID NO: 3888 - DNA, 17 bp; single-stranded, linear
aagaaacuuguaaaccg

SEQ ID NO: 3889 - DNA, 17 bp; single-stranded, linear
aaacuuguaaaccgaga

SEQ ID NO: 3890 - DNA, 17 bp; single-stranded, linear
cgagaccuaaaaaccca

SEQ ID NO: 3891 - DNA, 17 bp; single-stranded, linear
aacccagucugggagug

SEQ ID NO: 3892 - DNA, 17 bp; single-stranded, linear
gaagaaauuuuugagca

SEQ ID NO: 3893 - DNA, 17 bp; single-stranded, linear
aagaaauuuuugagcac

SEQ ID NO: 3894 - DNA, 17 bp; single-stranded, linear
agaaauuuuugagcacc

SEQ ID NO: 3895 - DNA, 17 bp; single-stranded, linear
gaaauuuuugagcaccu

SEQ ID NO: 3896 - DNA, 17 bp; single-stranded, linear
gagcaccuuaacuauag

SEQ ID NO: 3897 - DNA, 17 bp; single-stranded, linear
agcaccuuaacuauaga

SEQ ID NO: 3898 - DNA, 17 bp; single-stranded, linear
ccuuaacuauagauggu

SEQ ID NO: 3899 - DNA, 17 bp; single-stranded, linear
uuaacuauagauggugu

SEQ ID NO: 3900 - DNA, 17 bp; single-stranded, linear
gaugguguaacccggag

SEQ ID NO: 3901 - DNA, 17 bp; single-stranded, linear
ccaaggauuguacaccu

SEQ ID NO: 3902 - DNA, 17 bp; single-stranded, linear
aggauuguacaccugug

SEQ ID NO: 3903 - DNA, 17 bp; single-stranded, linear
ugcagcauccagugggc

SEQ ID NO: 3904 - DNA, 17 bp; single-stranded, linear
cagcacauuugucaggg

SEQ ID NO: 3905 - DNA, 17 bp; single-stranded, linear
agcacauuugucagggu

SEQ ID NO: 3906 - DNA, 17 bp; single-stranded, linear
acauuugucagggucca

SEQ ID NO: 3907 - DNA, 17 bp; single-stranded, linear
gucaggguccaugaaaa

SEQ ID NO: 3908 - DNA, 17 bp; single-stranded, linear
aaaaaccuuuuguugcu

SEQ ID NO: 3909 - DNA, 17 bp; single-stranded, linear
aaaaccuuuuguugcuu

SEQ ID NO: 3910 - DNA, 17 bp; single-stranded, linear
aaaccuuuuguugcuuu

SEQ ID NO: 3911 - DNA, 17 bp; single-stranded, linear
ccuuuuguugcuuuugg

SEQ ID NO: 3912 - DNA, 17 bp; single-stranded, linear
uuguugcuuuuggaagu

SEQ ID NO: 3913 - DNA, 17 bp; single-stranded, linear
uguugcuuuuggaagug

SEQ ID NO: 3914 - DNA, 17 bp; single-stranded, linear
guugcuuuuggaagugg

SEQ ID NO: 3915 - DNA, 17 bp; single-stranded, linear
cauggaaucucuggugg

SEQ ID NO: 3916 - DNA, 17 bp; single-stranded, linear
uggaaucucugguggaa

SEQ ID NO: 3917 - DNA, 17 bp; single-stranded, linear
gagcgugucagaauccc

SEQ ID NO: 3918 - DNA, 17 bp; single-stranded, linear
gucagaaucccugcgaa

SEQ ID NO: 3919 - DNA, 17 bp; single-stranded, linear
ugcgaaguaccuugguu

SEQ ID NO: 3920 - DNA, 17 bp; single-stranded, linear
aaguaccuugguuaccc

SEQ ID NO: 3921 - DNA, 17 bp; single-stranded, linear
accuugguuacccaccc

SEQ ID NO: 3922 - DNA, 17 bp; single-stranded, linear
ccuugguuacccacccc

SEQ ID NO: 3923 - DNA, 17 bp; single-stranded, linear
ccagaaauaaaauggua

SEQ ID NO: 3924 - DNA, 17 bp; single-stranded, linear
aaaaugguauaaaaaug

SEQ ID NO: 3925 - DNA, 17 bp; single-stranded, linear
aaugguauaaaaaugga

SEQ ID NO: 3926 - DNA, 17 bp; single-stranded, linear
aauggaauaccccuuga

SEQ ID NO: 3927 - DNA, 17 bp; single-stranded, linear
auaccccuugaguccaa

SEQ ID NO: 3928 - DNA, 17 bp; single-stranded, linear
ccuugaguccaaucaca

SEQ ID NO: 3929 - DNA, 17 bp; single-stranded, linear
aguccaaucacacaauu

SEQ ID NO: 3930 - DNA, 17 bp; single-stranded, linear
cacacaauuaaagcggg

SEQ ID NO: 3931 - DNA, 17 bp; single-stranded, linear
acacaauuaaagcgggg

SEQ ID NO: 3932 - DNA, 17 bp; single-stranded, linear
gggcauguacugacgau

SEQ ID NO: 3933 - DNA, 17 bp; single-stranded, linear
cugacgauuauggaagu

SEQ ID NO: 3934 - DNA, 17 bp; single-stranded, linear
ugacgauuauggaagug

SEQ ID NO: 3935 - DNA, 17 bp; single-stranded, linear
caggaaauuacacuguc

SEQ ID NO: 3936 - DNA, 17 bp; single-stranded, linear
aggaaauuacacuguca

SEQ ID NO: 3937 - DNA, 17 bp; single-stranded, linear
uacacugucauccuuac

SEQ ID NO: 3938 - DNA, 17 bp; single-stranded, linear
acugucauccuuaccaa

SEQ ID NO: 3939 - DNA, 17 bp; single-stranded, linear
gucauccuuaccaaucc

SEQ ID NO: 3940 - DNA, 17 bp; single-stranded, linear
ucauccuuaccaauccc

SEQ ID NO: 3941 - DNA, 17 bp; single-stranded, linear
uuaccaaucccauuuca

SEQ ID NO: 3942 - DNA, 17 bp; single-stranded, linear
aaucccauuucaaagga

SEQ ID NO: 3943 - DNA, 17 bp; single-stranded, linear
aucccauuucaaaggag

SEQ ID NO: 3944 - DNA, 17 bp; single-stranded, linear
ucccauuucaaaggaga

SEQ ID NO: 3945 - DNA, 17 bp; single-stranded, linear
cauguggucucucuggu

SEQ ID NO: 3946 - DNA, 17 bp; single-stranded, linear
uguggucucucugguug

SEQ ID NO: 3947 - DNA, 17 bp; single-stranded, linear
uggucucucugguugug

SEQ ID NO: 3948 - DNA, 17 bp; single-stranded, linear
ucucugguuguguaugu

SEQ ID NO: 3949 - DNA, 17 bp; single-stranded, linear
gguuguguaugucccac

SEQ ID NO: 3950 - DNA, 17 bp; single-stranded, linear
guguaugucccacccca

SEQ ID NO: 3951 - DNA, 17 bp; single-stranded, linear
ccccagauuggugagaa

SEQ ID NO: 3952 - DNA, 17 bp; single-stranded, linear
ugagaaaucucuaaucu

SEQ ID NO: 3953 - DNA, 17 bp; single-stranded, linear
agaaaucucuaaucucu

SEQ ID NO: 3954 - DNA, 17 bp; single-stranded, linear
aaaucucuaaucucucc

SEQ ID NO: 3955 - DNA, 17 bp; single-stranded, linear
ucucuaaucucuccugu

SEQ ID NO: 3956 - DNA, 17 bp; single-stranded, linear
ucuaaucucuccugugg

SEQ ID NO: 3957 - DNA, 17 bp; single-stranded, linear
uaaucucuccuguggau

SEQ ID NO: 3958 - DNA, 17 bp; single-stranded, linear
cuguggauuccuaccag

SEQ ID NO: 3959 - DNA, 17 bp; single-stranded, linear
uguggauuccuaccagu

SEQ ID NO: 3960 - DNA, 17 bp; single-stranded, linear
ggauuccuaccaguacg

SEQ ID NO: 3961 - DNA, 17 bp; single-stranded, linear
cuaccaguacggcacca

SEQ ID NO: 3962 - DNA, 17 bp; single-stranded, linear
gcaccacucaaacgcug

SEQ ID NO: 3963 - DNA, 17 bp; single-stranded, linear
ugacauguacggucuau

SEQ ID NO: 3964 - DNA, 17 bp; single-stranded, linear
uguacggucuaugccau

SEQ ID NO: 3965 - DNA, 17 bp; single-stranded, linear
uacggucuaugccauuc

SEQ ID NO: 3966 - DNA, 17 bp; single-stranded, linear
uaugccauuccuccccc

SEQ ID NO: 3967 - DNA, 17 bp; single-stranded, linear
augccauuccucccccg

SEQ ID NO: 3968 - DNA, 17 bp; single-stranded, linear
ccauuccucccccgcau

SEQ ID NO: 3969 - DNA, 17 bp; single-stranded, linear
ccccgcaucacauccac

SEQ ID NO: 3970 - DNA, 17 bp; single-stranded, linear
caucacauccacuggua

SEQ ID NO: 3971 - DNA, 17 bp; single-stranded, linear
ccacugguauuggcagu

SEQ ID NO: 3972 - DNA, 17 bp; single-stranded, linear
acugguauuggcaguug

SEQ ID NO: 3973 - DNA, 17 bp; single-stranded, linear
uuggcaguuggaggaag

SEQ ID NO: 3974 - DNA, 17 bp; single-stranded, linear
caagcugucucagugac

SEQ ID NO: 3975 - DNA, 17 bp; single-stranded, linear
agcugucucagugacaa

SEQ ID NO: 3976 - DNA, 17 bp; single-stranded, linear
aaacccauacccuugug

SEQ ID NO: 3977 - DNA, 17 bp; single-stranded, linear
cauacccuugugaagaa

SEQ ID NO: 3978 - DNA, 17 bp; single-stranded, linear
ggaggacuuccagggag

SEQ ID NO: 3979 - DNA, 17 bp; single-stranded, linear
gaggacuuccagggagg

SEQ ID NO: 3980 - DNA, 17 bp; single-stranded, linear
gaggaaauaaaauugaa

SEQ ID NO: 3981 - DNA, 17 bp; single-stranded, linear
aauaaaauugaaguuaa

SEQ ID NO: 3982 - DNA, 17 bp; single-stranded, linear
auugaaguuaauaaaaa

SEQ ID NO: 3983 - DNA, 17 bp; single-stranded, linear
uugaaguuaauaaaaau

SEQ ID NO: 3984 - DNA, 17 bp; single-stranded, linear
aaguuaauaaaaaucaa

SEQ ID NO: 3985 - DNA, 17 bp; single-stranded, linear
auaaaaaucaauuugcu

SEQ ID NO: 3986 - DNA, 17 bp; single-stranded, linear
aaaucaauuugcucuaa

SEQ ID NO: 3987 - DNA, 17 bp; single-stranded, linear
aaucaauuugcucuaau

SEQ ID NO: 3988 - DNA, 17 bp; single-stranded, linear
aauuugcucuaauugaa

SEQ ID NO: 3989 - DNA, 17 bp; single-stranded, linear
uuugcucuaauugaagg

SEQ ID NO: 3990 - DNA, 17 bp; single-stranded, linear
gcucuaauugaaggaaa

SEQ ID NO: 3991 - DNA, 17 bp; single-stranded, linear
aaaacuguaaguacccu

SEQ ID NO: 3992 - DNA, 17 bp; single-stranded, linear
cuguaaguacccuuguu

SEQ ID NO: 3993 - DNA, 17 bp; single-stranded, linear
aguacccuuguuaucca

SEQ ID NO: 3994 - DNA, 17 bp; single-stranded, linear
acccuuguuauccaagc

SEQ ID NO: 3995 - DNA, 17 bp; single-stranded, linear
cccuuguuauccaagcg

SEQ ID NO: 3996 - DNA, 17 bp; single-stranded, linear
cuuguuauccaagcggc

SEQ ID NO: 3997 - DNA, 17 bp; single-stranded, linear
aaaugugucagcuuugu

SEQ ID NO: 3998 - DNA, 17 bp; single-stranded, linear
ugucagcuuuguacaaa

SEQ ID NO: 3999 - DNA, 17 bp; single-stranded, linear
gucagcuuuguacaaau

SEQ ID NO: 4000 - DNA, 17 bp; single-stranded, linear
agcuuuguacaaaugug

SEQ ID NO: 4001 - DNA, 17 bp; single-stranded, linear
gaagcggucaacaaagu

SEQ ID NO: 4002 - DNA, 17 bp; single-stranded, linear
aacaaagucgggagagg

SEQ ID NO: 4003 - DNA, 17 bp; single-stranded, linear
agggugaucuccuucca

SEQ ID NO: 4004 - DNA, 17 bp; single-stranded, linear
ggugaucuccuuccacg

SEQ ID NO: 4005 - DNA, 17 bp; single-stranded, linear
gaucuccuuccacguga

SEQ ID NO: 4006 - DNA, 17 bp; single-stranded, linear
aucuccuuccacgugac

SEQ ID NO: 4007 - DNA, 17 bp; single-stranded, linear
ccagggguccugaaauu

SEQ ID NO: 4008 - DNA, 17 bp; single-stranded, linear
ccugaaauuacuuugca

SEQ ID NO: 4009 - DNA, 17 bp; single-stranded, linear
cugaaauuacuuugcaa

SEQ ID NO: 4010 - DNA, 17 bp; single-stranded, linear
aaauuacuuugcaaccu

SEQ ID NO: 4011 - DNA, 17 bp; single-stranded, linear
aauuacuuugcaaccug

SEQ ID NO: 4012 - DNA, 17 bp; single-stranded, linear
gagcgugucuuuguggu

SEQ ID NO: 4013 - DNA, 17 bp; single-stranded, linear
gcgugucuuuguggugc

SEQ ID NO: 4014 - DNA, 17 bp; single-stranded, linear
cgugucuuuguggugca

SEQ ID NO: 4015 - DNA, 17 bp; single-stranded, linear
agacagaucuacguuug

SEQ ID NO: 4016 - DNA, 17 bp; single-stranded, linear
acagaucuacguuugag

SEQ ID NO: 4017 - DNA, 17 bp; single-stranded, linear
aucuacguuugagaacc

SEQ ID NO: 4018 - DNA, 17 bp; single-stranded, linear
ucuacguuugagaaccu

SEQ ID NO: 4019 - DNA, 17 bp; single-stranded, linear
gagaaccucacauggua

SEQ ID NO: 4020 - DNA, 17 bp; single-stranded, linear
cacaugguacaagcuug

SEQ ID NO: 4021 - DNA, 17 bp; single-stranded, linear
uacaagcuuggcccaca

SEQ ID NO: 4022 - DNA, 17 bp; single-stranded, linear
cacagccucugccaauc

SEQ ID NO: 4023 - DNA, 17 bp; single-stranded, linear
cugccaauccauguggg

SEQ ID NO: 4024 - DNA, 17 bp; single-stranded, linear
gggagaguugcccacac

SEQ ID NO: 4025 - DNA, 17 bp; single-stranded, linear
acaccuguuugcaagaa

SEQ ID NO: 4026 - DNA, 17 bp; single-stranded, linear
caccuguuugcaagaac

SEQ ID NO: 4027 - DNA, 17 bp; single-stranded, linear
caagaacuuggauacuc

SEQ ID NO: 4028 - DNA, 17 bp; single-stranded, linear
acuuggauacucuuugg

SEQ ID NO: 4029 - DNA, 17 bp; single-stranded, linear
uggauacucuuuggaaa

SEQ ID NO: 4030 - DNA, 17 bp; single-stranded, linear
gauacucuuuggaaauu

SEQ ID NO: 4031 - DNA, 17 bp; single-stranded, linear
auacucuuuggaaauug

SEQ ID NO: 4032 - DNA, 17 bp; single-stranded, linear
uuggaaauugaaugcca

SEQ ID NO: 4033 - DNA, 17 bp; single-stranded, linear
caccauguucucuaaua

SEQ ID NO: 4034 - DNA, 17 bp; single-stranded, linear
accauguucucuaauag

SEQ ID NO: 4035 - DNA, 17 bp; single-stranded, linear
cauguucucuaauagca

SEQ ID NO: 4036 - DNA, 17 bp; single-stranded, linear
uguucucuaauagcaca

SEQ ID NO: 4037 - DNA, 17 bp; single-stranded, linear
ucucuaauagcacaaau

SEQ ID NO: 4038 - DNA, 17 bp; single-stranded, linear
aaugacauuuugaucau

SEQ ID NO: 4039 - DNA, 17 bp; single-stranded, linear
augacauuuugaucaug

SEQ ID NO: 4040 - DNA, 17 bp; single-stranded, linear
ugacauuuugaucaugg

SEQ ID NO: 4041 - DNA, 17 bp; single-stranded, linear
auuuugaucauggagcu

SEQ ID NO: 4042 - DNA, 17 bp; single-stranded, linear
auggagcuuaagaaugc

SEQ ID NO: 4043 - DNA, 17 bp; single-stranded, linear
uggagcuuaagaaugca

SEQ ID NO: 4044 - DNA, 17 bp; single-stranded, linear
gaaugcauccuugcagg

SEQ ID NO: 4045 - DNA, 17 bp; single-stranded, linear
ugcauccuugcaggacc

SEQ ID NO: 4046 - DNA, 17 bp; single-stranded, linear
aggagacuaugucugcc

SEQ ID NO: 4047 - DNA, 17 bp; single-stranded, linear
gacuaugucugccuugc

SEQ ID NO: 4048 - DNA, 17 bp; single-stranded, linear
gucugccuugcucaaga

SEQ ID NO: 4049 - DNA, 17 bp; single-stranded, linear
gccuugcucaagacagg

SEQ ID NO: 4050 - DNA, 17 bp; single-stranded, linear
aaagacauugcgugguc

SEQ ID NO: 4051 - DNA, 17 bp; single-stranded, linear
ugcguggucaggcagcu

SEQ ID NO: 4052 - DNA, 17 bp; single-stranded, linear
aggcagcucacaguccu

SEQ ID NO: 4053 - DNA, 17 bp; single-stranded, linear
cucacaguccuagagcg

SEQ ID NO: 4054 - DNA, 17 bp; single-stranded, linear
acaguccuagagcgugu

SEQ ID NO: 4055 - DNA, 17 bp; single-stranded, linear
cccacgaucacaggaaa

SEQ ID NO: 4056 - DNA, 17 bp; single-stranded, linear
uggagaaucagacgaca

SEQ ID NO: 4057 - DNA, 17 bp; single-stranded, linear
cgacaaguauuggggaa

SEQ ID NO: 4058 - DNA, 17 bp; single-stranded, linear
acaaguauuggggaaag

SEQ ID NO: 4059 - DNA, 17 bp; single-stranded, linear
gaaagcaucgaagucuc

SEQ ID NO: 4060 - DNA, 17 bp; single-stranded, linear
aucgaagucucaugcac

SEQ ID NO: 4061 - DNA, 17 bp; single-stranded, linear
cgaagucucaugcacgg

SEQ ID NO: 4062 - DNA, 17 bp; single-stranded, linear
cacggcaucugggaauc

SEQ ID NO: 4063 - DNA, 17 bp; single-stranded, linear
cugggaaucccccucca

SEQ ID NO: 4064 - DNA, 17 bp; single-stranded, linear
aucccccuccacagauc

SEQ ID NO: 4065 - DNA, 17 bp; single-stranded, linear
ccacagaucaugugguu

SEQ ID NO: 4066 - DNA, 17 bp; single-stranded, linear
caugugguuuaaagaua

SEQ ID NO: 4067 - DNA, 17 bp; single-stranded, linear
augugguuuaaagauaa

SEQ ID NO: 4068 - DNA, 17 bp; single-stranded, linear
ugugguuuaaagauaau

SEQ ID NO: 4069 - DNA, 17 bp; single-stranded, linear
uuaaagauaaugagacc

SEQ ID NO: 4070 - DNA, 17 bp; single-stranded, linear
gagacccuuguagaaga

SEQ ID NO: 4071 - DNA, 17 bp; single-stranded, linear
acccuuguagaagacuc

SEQ ID NO: 4072 - DNA, 17 bp; single-stranded, linear
agaagacucaggcauug

SEQ ID NO: 4073 - DNA, 17 bp; single-stranded, linear
ucaggcauuguauugaa

SEQ ID NO: 4074 - DNA, 17 bp; single-stranded, linear
ggcauuguauugaagga

SEQ ID NO: 4075 - DNA, 17 bp; single-stranded, linear
cauuguauugaaggaug

SEQ ID NO: 4076 - DNA, 17 bp; single-stranded, linear
cggaaccucacuauccg

SEQ ID NO: 4077 - DNA, 17 bp; single-stranded, linear
accucacuauccgcaga

SEQ ID NO: 4078 - DNA, 17 bp; single-stranded, linear
cucacuauccgcagagu

SEQ ID NO: 4079 - DNA, 17 bp; single-stranded, linear
gaaggccucuacaccug

SEQ ID NO: 4080 - DNA, 17 bp; single-stranded, linear
aggccucuacaccugcc

SEQ ID NO: 4081 - DNA, 17 bp; single-stranded, linear
ugcaguguucuuggcug

SEQ ID NO: 4082 - DNA, 17 bp; single-stranded, linear
gcaguguucuuggcugu

SEQ ID NO: 4083 - DNA, 17 bp; single-stranded, linear
aguguucuuggcugugc

SEQ ID NO: 4084 - DNA, 17 bp; single-stranded, linear
ggaggcauuuuucauaa

SEQ ID NO: 4085 - DNA, 17 bp; single-stranded, linear
gaggcauuuuucauaau

SEQ ID NO: 4086 - DNA, 17 bp; single-stranded, linear
aggcauuuuucauaaua

SEQ ID NO: 4087 - DNA, 17 bp; single-stranded, linear
ggcauuuuucauaauag

SEQ ID NO: 4088 - DNA, 17 bp; single-stranded, linear
gcauuuuucauaauaga

SEQ ID NO: 4089 - DNA, 17 bp; single-stranded, linear
uuuuucauaauagaagg

SEQ ID NO: 4090 - DNA, 17 bp; single-stranded, linear
uucauaauagaaggugc

SEQ ID NO: 4091 - DNA, 17 bp; single-stranded, linear
gacgaacuuggaaauca

SEQ ID NO: 4092 - DNA, 17 bp; single-stranded, linear
uuggaaaucauuauucu

SEQ ID NO: 4093 - DNA, 17 bp; single-stranded, linear
gaaaucauuauucuagu

SEQ ID NO: 4094 - DNA, 17 bp; single-stranded, linear
aaaucauuauucuagua

SEQ ID NO: 4095 - DNA, 17 bp; single-stranded, linear
aucauuauucuaguagg

SEQ ID NO: 4096 - DNA, 17 bp; single-stranded, linear
ucauuauucuaguaggc

SEQ ID NO: 4097 - DNA, 17 bp; single-stranded, linear
auuauucuaguaggcac

SEQ ID NO: 4098 - DNA, 17 bp; single-stranded, linear
auucuaguaggcacgac

SEQ ID NO: 4099 - DNA, 17 bp; single-stranded, linear
acggugauugccauguu

SEQ ID NO: 4100 - DNA, 17 bp; single-stranded, linear
ugccauguucuucuggc

SEQ ID NO: 4101 - DNA, 17 bp; single-stranded, linear
gccauguucuucuggcu

SEQ ID NO: 4102 - DNA, 17 bp; single-stranded, linear
cauguucuucuggcuac

SEQ ID NO: 4103 - DNA, 17 bp; single-stranded, linear
auguucuucuggcuacu

SEQ ID NO: 4104 - DNA, 17 bp; single-stranded, linear
uucuggcuacuucuugu

SEQ ID NO: 4105 - DNA, 17 bp; single-stranded, linear
uggcuacuucuugucau

SEQ ID NO: 4106 - DNA, 17 bp; single-stranded, linear
ggcuacuucuugucauc

SEQ ID NO: 4107 - DNA, 17 bp; single-stranded, linear
cuacuucuugucaucau

SEQ ID NO: 4108 - DNA, 17 bp; single-stranded, linear
cuucuugucaucauccu

SEQ ID NO: 4109 - DNA, 17 bp; single-stranded, linear
cuugucaucauccuagg

SEQ ID NO: 4110 - DNA, 17 bp; single-stranded, linear
gucaucauccuagggac

SEQ ID NO: 4111 - DNA, 17 bp; single-stranded, linear
aucauccuagggaccgu

SEQ ID NO: 4112 - DNA, 17 bp; single-stranded, linear
gggaccguuaagcgggc

SEQ ID NO: 4113 - DNA, 17 bp; single-stranded, linear
ggaccguuaagcgggcc

SEQ ID NO: 4114 - DNA, 17 bp; single-stranded, linear
gacaggcuacuugucca

SEQ ID NO: 4115 - DNA, 17 bp; single-stranded, linear
aggcuacuuguccaucg

SEQ ID NO: 4116 - DNA, 17 bp; single-stranded, linear
cuacuuguccaucguca

SEQ ID NO: 4117 - DNA, 17 bp; single-stranded, linear
uuguccaucgucaugga

SEQ ID NO: 4118 - DNA, 17 bp; single-stranded, linear
uccaucgucauggaucc

SEQ ID NO: 4119 - DNA, 17 bp; single-stranded, linear
ucauggauccagaugaa

SEQ ID NO: 4120 - DNA, 17 bp; single-stranded, linear
gaugaacucccauugga

SEQ ID NO: 4121 - DNA, 17 bp; single-stranded, linear
acucccauuggaugaac

SEQ ID NO: 4122 - DNA, 17 bp; single-stranded, linear
augaacauugugaacga

SEQ ID NO: 4123 - DNA, 17 bp; single-stranded, linear
gacugccuuaugaugcc

SEQ ID NO: 4124 - DNA, 17 bp; single-stranded, linear
acugccuuaugaugcca

SEQ ID NO: 4125 - DNA, 17 bp; single-stranded, linear
augggaauuccccagag

SEQ ID NO: 4126 - DNA, 17 bp; single-stranded, linear
ugggaauuccccagaga

SEQ ID NO: 4127 - DNA, 17 bp; single-stranded, linear
cugaaccuagguaagcc

SEQ ID NO: 4128 - DNA, 17 bp; single-stranded, linear
accuagguaagccucuu

SEQ ID NO: 4129 - DNA, 17 bp; single-stranded, linear
guaagccucuuggccgu

SEQ ID NO: 4130 - DNA, 17 bp; single-stranded, linear
aagccucuuggccgugg

SEQ ID NO: 4131 - DNA, 17 bp; single-stranded, linear
uggugccuuuggccaag

SEQ ID NO: 4132 - DNA, 17 bp; single-stranded, linear
ggugccuuuggccaaga

SEQ ID NO: 4133 - DNA, 17 bp; single-stranded, linear
caagagauugaagcaga

SEQ ID NO: 4134 - DNA, 17 bp; single-stranded, linear
agaugccuuuggaauug

SEQ ID NO: 4135 - DNA, 17 bp; single-stranded, linear
gaugccuuuggaauuga

SEQ ID NO: 4136 - DNA, 17 bp; single-stranded, linear
uuuggaauugacaagac

SEQ ID NO: 4137 - DNA, 17 bp; single-stranded, linear
cagcaacuugcaggaca

SEQ ID NO: 4138 - DNA, 17 bp; single-stranded, linear
aggacaguagcagucaa

SEQ ID NO: 4139 - DNA, 17 bp; single-stranded, linear
guagcagucaaaauguu

SEQ ID NO: 4140 - DNA, 17 bp; single-stranded, linear
caaaauguugaaagaag

SEQ ID NO: 4141 - DNA, 17 bp; single-stranded, linear
gugagcaucgagcucuc

SEQ ID NO: 4142 - DNA, 17 bp; single-stranded, linear
aucgagcucucaugucu

SEQ ID NO: 4143 - DNA, 17 bp; single-stranded, linear
cgagcucucaugucuga

SEQ ID NO: 4144 - DNA, 17 bp; single-stranded, linear
ucucaugucugaacuca

SEQ ID NO: 4145 - DNA, 17 bp; single-stranded, linear
ucugaacucaagauccu

SEQ ID NO: 4146 - DNA, 17 bp; single-stranded, linear
cucaagauccucauuca

SEQ ID NO: 4147 - DNA, 17 bp; single-stranded, linear
aagauccucauucauau

SEQ ID NO: 4148 - DNA, 17 bp; single-stranded, linear
auccucauucauauugg

SEQ ID NO: 4149 - DNA, 17 bp; single-stranded, linear
uccucauucauauuggu

SEQ ID NO: 4150 - DNA, 17 bp; single-stranded, linear
ucauucauauuggucac

SEQ ID NO: 4151 - DNA, 17 bp; single-stranded, linear
auucauauuggucacca

SEQ ID NO: 4152 - DNA, 17 bp; single-stranded, linear
auauuggucaccaucuc

SEQ ID NO: 4153 - DNA, 17 bp; single-stranded, linear
gucaccaucucaaugug

SEQ ID NO: 4154 - DNA, 17 bp; single-stranded, linear
caccaucucaauguggu

SEQ ID NO: 4155 - DNA, 17 bp; single-stranded, linear
aauguggucaaccuucu

SEQ ID NO: 4156 - DNA, 17 bp; single-stranded, linear
gucaaccuucuaggugc

SEQ ID NO: 4157 - DNA, 17 bp; single-stranded, linear
ucaaccuucuaggugcc

SEQ ID NO: 4158 - DNA, 17 bp; single-stranded, linear
aaccuucuaggugccug

SEQ ID NO: 4159 - DNA, 17 bp; single-stranded, linear
gugccuguaccaagcca

SEQ ID NO: 4160 - DNA, 17 bp; single-stranded, linear
gggccacucauggugau

SEQ ID NO: 4161 - DNA, 17 bp; single-stranded, linear
auggugauuguggaauu

SEQ ID NO: 4162 - DNA, 17 bp; single-stranded, linear
uguggaauucugcaaau

SEQ ID NO: 4163 - DNA, 17 bp; single-stranded, linear
guggaauucugcaaauu

SEQ ID NO: 4164 - DNA, 17 bp; single-stranded, linear
cugcaaauuuggaaacc

SEQ ID NO: 4165 - DNA, 17 bp; single-stranded, linear
ugcaaauuuggaaaccu

SEQ ID NO: 4166 - DNA, 17 bp; single-stranded, linear
aaaccuguccacuuacc

SEQ ID NO: 4167 - DNA, 17 bp; single-stranded, linear
uguccacuuaccugagg

SEQ ID NO: 4168 - DNA, 17 bp; single-stranded, linear
guccacuuaccugagga

SEQ ID NO: 4169 - DNA, 17 bp; single-stranded, linear
aaaugaauuuguccccu

SEQ ID NO: 4170 - DNA, 17 bp; single-stranded, linear
aaugaauuuguccccua

SEQ ID NO: 4171 - DNA, 17 bp; single-stranded, linear
gaauuuguccccuacaa

SEQ ID NO: 4172 - DNA, 17 bp; single-stranded, linear
uguccccuacaagacca

SEQ ID NO: 4173 - DNA, 17 bp; single-stranded, linear
ggcacgauuccgucaag

SEQ ID NO: 4174 - DNA, 17 bp; single-stranded, linear
gcacgauuccgucaagg

SEQ ID NO: 4175 - DNA, 17 bp; single-stranded, linear
gauuccgucaagggaaa

SEQ ID NO: 4176 - DNA, 17 bp; single-stranded, linear
gaaagacuacguuggag

SEQ ID NO: 4177 - DNA, 17 bp; single-stranded, linear
gacuacguuggagcaau

SEQ ID NO: 4178 - DNA, 17 bp; single-stranded, linear
ggagcaaucccugugga

SEQ ID NO: 4179 - DNA, 17 bp; single-stranded, linear
cuguggaucugaaacgg

SEQ ID NO: 4180 - DNA, 17 bp; single-stranded, linear
acggcgcuuggacagca

SEQ ID NO: 4181 - DNA, 17 bp; single-stranded, linear
gacagcaucaccaguag

SEQ ID NO: 4182 - DNA, 17 bp; single-stranded, linear
ucaccaguagccagagc

SEQ ID NO: 4183 - DNA, 17 bp; single-stranded, linear
ccagagcucagccagcu

SEQ ID NO: 4184 - DNA, 17 bp; single-stranded, linear
agccagcucuggauuug

SEQ ID NO: 4185 - DNA, 17 bp; single-stranded, linear
cucuggauuuguggagg

SEQ ID NO: 4186 - DNA, 17 bp; single-stranded, linear
ucuggauuuguggagga

SEQ ID NO: 4187 - DNA, 17 bp; single-stranded, linear
ggagaagucccucagug

SEQ ID NO: 4188 - DNA, 17 bp; single-stranded, linear
aagucccucagugaugu

SEQ ID NO: 4189 - DNA, 17 bp; single-stranded, linear
agugauguagaagaaga

SEQ ID NO: 4190 - DNA, 17 bp; single-stranded, linear
aggaagcuccugaagau

SEQ ID NO: 4191 - DNA, 17 bp; single-stranded, linear
cugaagaucuguauaag

SEQ ID NO: 4192 - DNA, 17 bp; single-stranded, linear
agaucuguauaaggacu

SEQ ID NO: 4193 - DNA, 17 bp; single-stranded, linear
aucuguauaaggacuuc

SEQ ID NO: 4194 - DNA, 17 bp; single-stranded, linear
uaaggacuuccugaccu

SEQ ID NO: 4195 - DNA, 17 bp; single-stranded, linear
aaggacuuccugaccuu

SEQ ID NO: 4196 - DNA, 17 bp; single-stranded, linear
ccugaccuuggagcauc

SEQ ID NO: 4197 - DNA, 17 bp; single-stranded, linear
uggagcaucucaucugu

SEQ ID NO: 4198 - DNA, 17 bp; single-stranded, linear
gagcaucucaucuguua

SEQ ID NO: 4199 - DNA, 17 bp; single-stranded, linear
caucucaucuguuacag

SEQ ID NO: 4200 - DNA, 17 bp; single-stranded, linear
ucaucuguuacagcuuc

SEQ ID NO: 4201 - DNA, 17 bp; single-stranded, linear
caucuguuacagcuucc

SEQ ID NO: 4202 - DNA, 17 bp; single-stranded, linear
uuacagcuuccaagugg

SEQ ID NO: 4203 - DNA, 17 bp; single-stranded, linear
uacagcuuccaaguggc

SEQ ID NO: 4204 - DNA, 17 bp; single-stranded, linear
aaguggcuaagggcaug

SEQ ID NO: 4205 - DNA, 17 bp; single-stranded, linear
cauggaguucuuggcau

SEQ ID NO: 4206 - DNA, 17 bp; single-stranded, linear
auggaguucuuggcauc

SEQ ID NO: 4207 - DNA, 17 bp; single-stranded, linear
ggaguucuuggcaucgc

SEQ ID NO: 4208 - DNA, 17 bp; single-stranded, linear
cuuggcaucgcgaaagu

SEQ ID NO: 4209 - DNA, 17 bp; single-stranded, linear
gaaaguguauccacagg

SEQ ID NO: 4210 - DNA, 17 bp; single-stranded, linear
aaguguauccacaggga

SEQ ID NO: 4211 - DNA, 17 bp; single-stranded, linear
cacgaaauauccucuua

SEQ ID NO: 4212 - DNA, 17 bp; single-stranded, linear
cgaaauauccucuuauc

SEQ ID NO: 4213 - DNA, 17 bp; single-stranded, linear
aauauccucuuaucgga

SEQ ID NO: 4214 - DNA, 17 bp; single-stranded, linear
uauccucuuaucggaga

SEQ ID NO: 4215 - DNA, 17 bp; single-stranded, linear
auccucuuaucggagaa

SEQ ID NO: 4216 - DNA, 17 bp; single-stranded, linear
ccucuuaucggagaaga

SEQ ID NO: 4217 - DNA, 17 bp; single-stranded, linear
aacgugguuaaaaucug

SEQ ID NO: 4218 - DNA, 17 bp; single-stranded, linear
acgugguuaaaaucugu

SEQ ID NO: 4219 - DNA, 17 bp; single-stranded, linear
guuaaaaucugugacuu

SEQ ID NO: 4220 - DNA, 17 bp; single-stranded, linear
cugugacuuuggcuugg

SEQ ID NO: 4221 - DNA, 17 bp; single-stranded, linear
ugugacuuuggcuuggc

SEQ ID NO: 4222 - DNA, 17 bp; single-stranded, linear
cuuuggcuuggcccggg

SEQ ID NO: 4223 - DNA, 17 bp; single-stranded, linear
cccgggauauuuauaaa

SEQ ID NO: 4224 - DNA, 17 bp; single-stranded, linear
cgggauauuuauaaaga

SEQ ID NO: 4225 - DNA, 17 bp; single-stranded, linear
gggauauuuauaaagau

SEQ ID NO: 4226 - DNA, 17 bp; single-stranded, linear
ggauauuuauaaagauc

SEQ ID NO: 4227 - DNA, 17 bp; single-stranded, linear
auauuuauaaagaucca

SEQ ID NO: 4228 - DNA, 17 bp; single-stranded, linear
auaaagauccagauuau

SEQ ID NO: 4229 - DNA, 17 bp; single-stranded, linear
auccagauuaugucaga

SEQ ID NO: 4230 - DNA, 17 bp; single-stranded, linear
uccagauuaugucagaa

SEQ ID NO: 4231 - DNA, 17 bp; single-stranded, linear
gauuaugucagaaaagg

SEQ ID NO: 4232 - DNA, 17 bp; single-stranded, linear
gagaugcucgccucccu

SEQ ID NO: 4233 - DNA, 17 bp; single-stranded, linear
gcucgccucccuuugaa

SEQ ID NO: 4234 - DNA, 17 bp; single-stranded, linear
gccucccuuugaaaugg

SEQ ID NO: 4235 - DNA, 17 bp; single-stranded, linear
ccucccuuugaaaugga

SEQ ID NO: 4236 - DNA, 17 bp; single-stranded, linear
gaaacaauuuuugacag

SEQ ID NO: 4237 - DNA, 17 bp; single-stranded, linear
aaacaauuuuugacaga

SEQ ID NO: 4238 - DNA, 17 bp; single-stranded, linear
aacaauuuuugacagag

SEQ ID NO: 4239 - DNA, 17 bp; single-stranded, linear
acaauuuuugacagagu

SEQ ID NO: 4240 - DNA, 17 bp; single-stranded, linear
cagaguguacacaaucc

SEQ ID NO: 4241 - DNA, 17 bp; single-stranded, linear
uacacaauccagaguga

SEQ ID NO: 4242 - DNA, 17 bp; single-stranded, linear
agugacgucuggucuuu

SEQ ID NO: 4243 - DNA, 17 bp; single-stranded, linear
cgucuggucuuuuggug

SEQ ID NO: 4244 - DNA, 17 bp; single-stranded, linear
ucuggucuuuugguguu

SEQ ID NO: 4245 - DNA, 17 bp; single-stranded, linear
cuggucuuuugguguuu

SEQ ID NO: 4246 - DNA, 17 bp; single-stranded, linear
uggucuuuugguguuuu

SEQ ID NO: 4247 - DNA, 17 bp; single-stranded, linear
uuugguguuuugcugug

SEQ ID NO: 4248 - DNA, 17 bp; single-stranded, linear
uugguguuuugcugugg

SEQ ID NO: 4249 - DNA, 17 bp; single-stranded, linear
ugguguuuugcuguggg

SEQ ID NO: 4250 - DNA, 17 bp; single-stranded, linear
ugggaaauauuuuccuu

SEQ ID NO: 4251 - DNA, 17 bp; single-stranded, linear
ggaaauauuuuccuuag

SEQ ID NO: 4252 - DNA, 17 bp; single-stranded, linear
gaaauauuuuccuuagg

SEQ ID NO: 4253 - DNA, 17 bp; single-stranded, linear
aaauauuuuccuuaggu

SEQ ID NO: 4254 - DNA, 17 bp; single-stranded, linear
aauauuuuccuuaggug

SEQ ID NO: 4255 - DNA, 17 bp; single-stranded, linear
auuuuccuuaggugcuu

SEQ ID NO: 4256 - DNA, 17 bp; single-stranded, linear
uuuuccuuaggugcuuc

SEQ ID NO: 4257 - DNA, 17 bp; single-stranded, linear
uaggugcuucuccauau

SEQ ID NO: 4258 - DNA, 17 bp; single-stranded, linear
aggugcuucuccauauc

SEQ ID NO: 4259 - DNA, 17 bp; single-stranded, linear
gugcuucuccauauccu

SEQ ID NO: 4260 - DNA, 17 bp; single-stranded, linear
uucuccauauccugggg

SEQ ID NO: 4261 - DNA, 17 bp; single-stranded, linear
cuccauauccuggggua

SEQ ID NO: 4262 - DNA, 17 bp; single-stranded, linear
ccugggguaaagauuga

SEQ ID NO: 4263 - DNA, 17 bp; single-stranded, linear
guaaagauugaugaaga

SEQ ID NO: 4264 - DNA, 17 bp; single-stranded, linear
ugaagaauuuuguaggc

SEQ ID NO: 4265 - DNA, 17 bp; single-stranded, linear
gaagaauuuuguaggcg

SEQ ID NO: 4266 - DNA, 17 bp; single-stranded, linear
aagaauuuuguaggcga

SEQ ID NO: 4267 - DNA, 17 bp; single-stranded, linear
aauuuuguaggcgauug

SEQ ID NO: 4268 - DNA, 17 bp; single-stranded, linear
uaggcgauugaaagaag

SEQ ID NO: 4269 - DNA, 17 bp; single-stranded, linear
aaggaacuagaaugagg

SEQ ID NO: 4270 - DNA, 17 bp; single-stranded, linear
ccccugauuauacuaca

SEQ ID NO: 4271 - DNA, 17 bp; single-stranded, linear
cccugauuauacuacac

SEQ ID NO: 4272 - DNA, 17 bp; single-stranded, linear
cugauuauacuacacca

SEQ ID NO: 4273 - DNA, 17 bp; single-stranded, linear
auuauacuacaccagaa

SEQ ID NO: 4274 - DNA, 17 bp; single-stranded, linear
agaaauguaccagacca

SEQ ID NO: 4275 - DNA, 17 bp; single-stranded, linear
agcccagucagagaccc

SEQ ID NO: 4276 - DNA, 17 bp; single-stranded, linear
acccacguuuucagagu

SEQ ID NO: 4277 - DNA, 17 bp; single-stranded, linear
cccacguuuucagaguu

SEQ ID NO: 4278 - DNA, 17 bp; single-stranded, linear
ccacguuuucagaguug

SEQ ID NO: 4279 - DNA, 17 bp; single-stranded, linear
cacguuuucagaguugg

SEQ ID NO: 4280 - DNA, 17 bp; single-stranded, linear
uucagaguugguggaac

SEQ ID NO: 4281 - DNA, 17 bp; single-stranded, linear
uggaacauuugggaaau

SEQ ID NO: 4282 - DNA, 17 bp; single-stranded, linear
ggaacauuugggaaauc

SEQ ID NO: 4283 - DNA, 17 bp; single-stranded, linear
ugggaaaucucuugcaa

SEQ ID NO: 4284 - DNA, 17 bp; single-stranded, linear
ggaaaucucuugcaagc

SEQ ID NO: 4285 - DNA, 17 bp; single-stranded, linear
aaaucucuugcaagcua

SEQ ID NO: 4286 - DNA, 17 bp; single-stranded, linear
ugcaagcuaaugcucag

SEQ ID NO: 4287 - DNA, 17 bp; single-stranded, linear
cuaaugcucagcaggau

SEQ ID NO: 4288 - DNA, 17 bp; single-stranded, linear
caaagacuacauuguuc

SEQ ID NO: 4289 - DNA, 17 bp; single-stranded, linear
gacuacauuguucuucc

SEQ ID NO: 4290 - DNA, 17 bp; single-stranded, linear
uacauuguucuuccgau

SEQ ID NO: 4291 - DNA, 17 bp; single-stranded, linear
acauuguucuuccgaua

SEQ ID NO: 4292 - DNA, 17 bp; single-stranded, linear
auuguucuuccgauauc

SEQ ID NO: 4293 - DNA, 17 bp; single-stranded, linear
uuguucuuccgauauca

SEQ ID NO: 4294 - DNA, 17 bp; single-stranded, linear
cuuccgauaucagagac

SEQ ID NO: 4295 - DNA, 17 bp; single-stranded, linear
uccgauaucagagacuu

SEQ ID NO: 4296 - DNA, 17 bp; single-stranded, linear
cagagacuuugagcaug

SEQ ID NO: 4297 - DNA, 17 bp; single-stranded, linear
agagacuuugagcaugg

SEQ ID NO: 4298 - DNA, 17 bp; single-stranded, linear
aagaggauucuggacuc

SEQ ID NO: 4299 - DNA, 17 bp; single-stranded, linear
agaggauucuggacucu

SEQ ID NO: 4300 - DNA, 17 bp; single-stranded, linear
ucuggacucucucugcc

SEQ ID NO: 4301 - DNA, 17 bp; single-stranded, linear
uggacucucucugccua

SEQ ID NO: 4302 - DNA, 17 bp; single-stranded, linear
gacucucucugccuacc

SEQ ID NO: 4303 - DNA, 17 bp; single-stranded, linear
cucugccuaccucaccu

SEQ ID NO: 4304 - DNA, 17 bp; single-stranded, linear
gccuaccucaccuguuu

SEQ ID NO: 4305 - DNA, 17 bp; single-stranded, linear
ucaccuguuuccuguau

SEQ ID NO: 4306 - DNA, 17 bp; single-stranded, linear
caccuguuuccuguaug

SEQ ID NO: 4307 - DNA, 17 bp; single-stranded, linear
accuguuuccuguaugg

SEQ ID NO: 4308 - DNA, 17 bp; single-stranded, linear
uuuccuguauggaggag

SEQ ID NO: 4309 - DNA, 17 bp; single-stranded, linear
gaggaaguaugugaccc

SEQ ID NO: 4310 - DNA, 17 bp; single-stranded, linear
ccccaaauuccauuaug

SEQ ID NO: 4311 - DNA, 17 bp; single-stranded, linear
cccaaauuccauuauga

SEQ ID NO: 4312 - DNA, 17 bp; single-stranded, linear
aauuccauuaugacaac

SEQ ID NO: 4313 - DNA, 17 bp; single-stranded, linear
auuccauuaugacaaca

SEQ ID NO: 4314 - DNA, 17 bp; single-stranded, linear
gcaggaaucagucagua

SEQ ID NO: 4315 - DNA, 17 bp; single-stranded, linear
gaaucagucaguaucug

SEQ ID NO: 4316 - DNA, 17 bp; single-stranded, linear
cagucaguaucugcaga

SEQ ID NO: 4317 - DNA, 17 bp; single-stranded, linear
gucaguaucugcagaac

SEQ ID NO: 4318 - DNA, 17 bp; single-stranded, linear
agaacaguaagcgaaag

SEQ ID NO: 4319 - DNA, 17 bp; single-stranded, linear
gugaguguaaaaacauu

SEQ ID NO: 4320 - DNA, 17 bp; single-stranded, linear
aaaaacauuugaagaua

SEQ ID NO: 4321 - DNA, 17 bp; single-stranded, linear
aaaacauuugaagauau

SEQ ID NO: 4322 - DNA, 17 bp; single-stranded, linear
uugaagauaucccguua

SEQ ID NO: 4323 - DNA, 17 bp; single-stranded, linear
gaagauaucccguuaga

SEQ ID NO: 4324 - DNA, 17 bp; single-stranded, linear
uaucccguuagaagaac

SEQ ID NO: 4325 - DNA, 17 bp; single-stranded, linear
aucccguuagaagaacc

SEQ ID NO: 4326 - DNA, 17 bp; single-stranded, linear
ccagaaguaaaaguaau

SEQ ID NO: 4327 - DNA, 17 bp; single-stranded, linear
guaaaaguaaucccaga

SEQ ID NO: 4328 - DNA, 17 bp; single-stranded, linear
aaaguaaucccagauga

SEQ ID NO: 4329 - DNA, 17 bp; single-stranded, linear
acagugguaugguucuu

SEQ ID NO: 4330 - DNA, 17 bp; single-stranded, linear
gguaugguucuugccuc

SEQ ID NO: 4331 - DNA, 17 bp; single-stranded, linear
guaugguucuugccuca

SEQ ID NO: 4332 - DNA, 17 bp; single-stranded, linear
augguucuugccucaga

SEQ ID NO: 4333 - DNA, 17 bp; single-stranded, linear
ucuugccucagaagagc

SEQ ID NO: 4334 - DNA, 17 bp; single-stranded, linear
ugaaaacuuuggaagac

SEQ ID NO: 4335 - DNA, 17 bp; single-stranded, linear
gaaaacuuuggaagaca

SEQ ID NO: 4336 - DNA, 17 bp; single-stranded, linear
aaccaaauuaucuccau

SEQ ID NO: 4337 - DNA, 17 bp; single-stranded, linear
accaaauuaucuccauc

SEQ ID NO: 4338 - DNA, 17 bp; single-stranded, linear
caaauuaucuccaucuu

SEQ ID NO: 4339 - DNA, 17 bp; single-stranded, linear
aauuaucuccaucuuuu

SEQ ID NO: 4340 - DNA, 17 bp; single-stranded, linear
aucuccaucuuuuggug

SEQ ID NO: 4341 - DNA, 17 bp; single-stranded, linear
cuccaucuuuuggugga

SEQ ID NO: 4342 - DNA, 17 bp; single-stranded, linear
uccaucuuuugguggaa

SEQ ID NO: 4343 - DNA, 17 bp; single-stranded, linear
ccaucuuuugguggaau

SEQ ID NO: 4344 - DNA, 17 bp; single-stranded, linear
cagggagucuguggcau

SEQ ID NO: 4345 - DNA, 17 bp; single-stranded, linear
uguggcaucugaaggcu

SEQ ID NO: 4346 - DNA, 17 bp; single-stranded, linear
ugaaggcucaaaccaga

SEQ ID NO: 4347 - DNA, 17 bp; single-stranded, linear
aagcggcuaccaguccg

SEQ ID NO: 4348 - DNA, 17 bp; single-stranded, linear
cuaccaguccggauauc

SEQ ID NO: 4349 - DNA, 17 bp; single-stranded, linear
guccggauaucacuccg

SEQ ID NO: 4350 - DNA, 17 bp; single-stranded, linear
ccggauaucacuccgau

SEQ ID NO: 4351 - DNA, 17 bp; single-stranded, linear
auaucacuccgaugaca

SEQ ID NO: 4352 - DNA, 17 bp; single-stranded, linear
caccguguacuccagug

SEQ ID NO: 4353 - DNA, 17 bp; single-stranded, linear
cguguacuccagugagg

SEQ ID NO: 4354 - DNA, 17 bp; single-stranded, linear
gcagaacuuuuaaagcu

SEQ ID NO: 4355 - DNA, 17 bp; single-stranded, linear
cagaacuuuuaaagcug

SEQ ID NO: 4356 - DNA, 17 bp; single-stranded, linear
agaacuuuuaaagcuga

SEQ ID NO: 4357 - DNA, 17 bp; single-stranded, linear
gaacuuuuaaagcugau

SEQ ID NO: 4358 - DNA, 17 bp; single-stranded, linear
aagcugauagagauugg

SEQ ID NO: 4359 - DNA, 17 bp; single-stranded, linear
auagagauuggagugca

SEQ ID NO: 4360 - DNA, 17 bp; single-stranded, linear
aaaccgguagcacagcc

SEQ ID NO: 4361 - DNA, 17 bp; single-stranded, linear
gcccagauucuccagcc

SEQ ID NO: 4362 - DNA, 17 bp; single-stranded, linear
cccagauucuccagccu

SEQ ID NO: 4363 - DNA, 17 bp; single-stranded, linear
cagauucuccagccuga

SEQ ID NO: 4364 - DNA, 17 bp; single-stranded, linear
acugagcucuccuccug

SEQ ID NO: 4365 - DNA, 17 bp; single-stranded, linear
ugagcucuccuccuguu

SEQ ID NO: 4366 - DNA, 17 bp; single-stranded, linear
gcucuccuccuguuuaa

SEQ ID NO: 4367 - DNA, 17 bp; single-stranded, linear
ccuccuguuuaaaagga

SEQ ID NO: 4368 - DNA, 17 bp; single-stranded, linear
cuccuguuuaaaaggaa

SEQ ID NO: 4369 - DNA, 17 bp; single-stranded, linear
uccuguuuaaaaggaag

SEQ ID NO: 4370 - DNA, 17 bp; single-stranded, linear
ggaagcauccacacccc

SEQ ID NO: 4371 - DNA, 17 bp; single-stranded, linear
ccccaacucccggacau

SEQ ID NO: 4372 - DNA, 17 bp; single-stranded, linear
ccggacaucacaugaga

SEQ ID NO: 4373 - DNA, 17 bp; single-stranded, linear
ugagaggucugcucaga

SEQ ID NO: 4374 - DNA, 17 bp; single-stranded, linear
ggucugcucagauuuug

SEQ ID NO: 4375 - DNA, 17 bp; single-stranded, linear
gcucagauuuugaagug

SEQ ID NO: 4376 - DNA, 17 bp; single-stranded, linear
cucagauuuugaagugu

SEQ ID NO: 4377 - DNA, 17 bp; single-stranded, linear
ucagauuuugaaguguu

SEQ ID NO: 4378 - DNA, 17 bp; single-stranded, linear
ugaaguguuguucuuuc

SEQ ID NO: 4379 - DNA, 17 bp; single-stranded, linear
aguguuguucuuuccac

SEQ ID NO: 4380 - DNA, 17 bp; single-stranded, linear
guguuguucuuuccacc

SEQ ID NO: 4381 - DNA, 17 bp; single-stranded, linear
guuguucuuuccaccag

SEQ ID NO: 4382 - DNA, 17 bp; single-stranded, linear
uuguucuuuccaccagc

SEQ ID NO: 4383 - DNA, 17 bp; single-stranded, linear
uguucuuuccaccagca

SEQ ID NO: 4384 - DNA, 17 bp; single-stranded, linear
caggaaguagccgcauu

SEQ ID NO: 4385 - DNA, 17 bp; single-stranded, linear
agccgcauuugauuuuc

SEQ ID NO: 4386 - DNA, 17 bp; single-stranded, linear
gccgcauuugauuuuca

SEQ ID NO: 4387 - DNA, 17 bp; single-stranded, linear
cauuugauuuucauuuc

SEQ ID NO: 4388 - DNA, 17 bp; single-stranded, linear
auuugauuuucauuucg

SEQ ID NO: 4389 - DNA, 17 bp; single-stranded, linear
uuugauuuucauuucga

SEQ ID NO: 4390 - DNA, 17 bp; single-stranded, linear
uugauuuucauuucgac

SEQ ID NO: 4391 - DNA, 17 bp; single-stranded, linear
auuuucauuucgacaac

SEQ ID NO: 4392 - DNA, 17 bp; single-stranded, linear
uuuucauuucgacaaca

SEQ ID NO: 4393 - DNA, 17 bp; single-stranded, linear
uuucauuucgacaacag

SEQ ID NO: 4394 - DNA, 17 bp; single-stranded, linear
aaggaccucggacugca

SEQ ID NO: 4395 - DNA, 17 bp; single-stranded, linear
agccagcucuucuaggc

SEQ ID NO: 4396 - DNA, 17 bp; single-stranded, linear
ccagcucuucuaggcuu

SEQ ID NO: 4397 - DNA, 17 bp; single-stranded, linear
cagcucuucuaggcuug

SEQ ID NO: 4398 - DNA, 17 bp; single-stranded, linear
gcucuucuaggcuugug

SEQ ID NO: 4399 - DNA, 54 bp; single-stranded, linear
cgacggccagaagcaccuaccagagaaacacacguugugguacauuaccuggua

SEQ ID NO: 4400 - DNA, 54 bp; single-stranded, linear
cacagggcagaagccagcaccagagaaacacacguugugguacauuaccuggua

SEQ ID NO: 4401 - DNA, 54 bp; single-stranded, linear
cccacagaagaagcccggaccagagaaacacacguugugguacauuaccuggua

SEQ ID NO: 4402 - DNA, 54 bp; single-stranded, linear
ugagccugagaagaucaaaccagagaaacacacguugugguacauuaccuggua

SEQ ID NO: 4403 - DNA, 54 bp; single-stranded, linear
gaggccaaagaaguuuccaccagagaaacacacguugugguacauuaccuggua

SEQ ID NO: 4404 - DNA, 54 bp; single-stranded, linear
aaauggagagaaguaaucaccagagaaacacacguugugguacauuaccuggua

SEQ ID NO: 4405 - DNA, 54 bp; single-stranded, linear
cuguuaccagaaggaacaaccagagaaacacacguugugguacauuaccuggua

SEQ ID NO: 4406 - DNA, 54 bp; single-stranded, linear
acauaauaagaagguaacaccagagaaacacacguugugguacauuaccuggua

SEQ ID NO: 4407 - DNA, 54 bp; single-stranded, linear
uuccaugaagaagacucaaccagagaaacacacguugugguacauuaccuggua

SEQ ID NO: 4408 - DNA, 54 bp; single-stranded, linear
uuuucuccagaagauaguaccagagaaacacacguugugguacauuaccuggua

SEQ ID NO: 4409 - DNA, 54 bp; single-stranded, linear
cacucccaagaaggguuuaccagagaaacacacguugugguacauuaccuggua

SEQ ID NO: 4410 - DNA, 54 bp; single-stranded, linear
ucuuggucagaagcccacaccagagaaacacacguugugguacauuaccuggua

SEQ ID NO: 4411 - DNA, 54 bp; single-stranded, linear
ccauaaucagaaguacauaccagagaaacacacguugugguacauuaccuggua

SEQ ID NO: 4412 - DNA, 54 bp; single-stranded, linear
ucucaccaagaaggggugaccagagaaacacacguugugguacauuaccuggua

SEQ ID NO: 4413 - DNA, 54 bp; single-stranded, linear
auggcauaagaaguacauaccagagaaacacacguugugguacauuaccuggua

SEQ ID NO: 4414 - DNA, 54 bp; single-stranded, linear
cuuccuccagaagccaauaccagagaaacacacguugugguacauuaccuggua

SEQ ID NO: 4415 - DNA, 54 bp; single-stranded, linear
gucacugaagaagcuuggaccagagaaacacacguugugguacauuaccuggua

SEQ ID NO: 4416 - DNA, 54 bp; single-stranded, linear
uuguacaaagaagacacaaccagagaaacacacguugugguacauuaccuggua

SEQ ID NO: 4417 - DNA, 54 bp; single-stranded, linear
gcucagugagaagcauguaccagagaaacacacguugugguacauuaccuggua

SEQ ID NO: 4418 - DNA, 54 bp; single-stranded, linear
aaacguagagaagucugcaccagagaaacacacguugugguacauuaccuggua

SEQ ID NO: 4419 - DNA, 54 bp; single-stranded, linear
uuggcagaagaagugggcaccagagaaacacacguugugguacauuaccuggua

SEQ ID NO: 4420 - DNA, 54 bp; single-stranded, linear
uucuugcaagaaggugugaccagagaaacacacguugugguacauuaccuggua

SEQ ID NO: 4421 - DNA, 54 bp; single-stranded, linear
uugagcaaagaagacauaaccagagaaacacacguugugguacauuaccuggua

SEQ ID NO: 4422 - DNA, 54 bp; single-stranded, linear
ggacugugagaagccugaaccagagaaacacacguugugguacauuaccuggua

SEQ ID NO: 4423 - DNA, 54 bp; single-stranded, linear
cgcucuagagaagugagcaccagagaaacacacguugugguacauuaccuggua

SEQ ID NO: 4424 - DNA, 54 bp; single-stranded, linear
uacuugucagaagauucuaccagagaaacacacguugugguacauuaccuggua

SEQ ID NO: 4425 - DNA, 54 bp; single-stranded, linear
accacaugagaaguggagaccagagaaacacacguugugguacauuaccuggua

SEQ ID NO: 4426 - DNA, 54 bp; single-stranded, linear
gggaguucagaaggauccaccagagaaacacacguugugguacauuaccuggua

SEQ ID NO: 4427 - DNA, 54 bp; single-stranded, linear
caucauaaagaagucguuaccagagaaacacacguugugguacauuaccuggua

SEQ ID NO: 4428 - DNA, 54 bp; single-stranded, linear
cuagguucagaaggucucaccagagaaacacacguugugguacauuaccuggua

SEQ ID NO: 4429 - DNA, 54 bp; single-stranded, linear
ccaaaggcagaagcuucaaccagagaaacacacguugugguacauuaccuggua

SEQ ID NO: 4430 - DNA, 54 bp; single-stranded, linear
gguaagugagaagguuucaccagagaaacacacguugugguacauuaccuggua

SEQ ID NO: 4431 - DNA, 54 bp; single-stranded, linear
aaauccagagaaggcugaaccagagaaacacacguugugguacauuaccuggua

SEQ ID NO: 4432 - DNA, 54 bp; single-stranded, linear
gcuccaagagaaggaaguaccagagaaacacacguugugguacauuaccuggua

SEQ ID NO: 4433 - DNA, 54 bp; single-stranded, linear
cacuuggaagaaguaacaaccagagaaacacacguugugguacauuaccuggua

SEQ ID NO: 4434 - DNA, 54 bp; single-stranded, linear
cugacauaagaaggaucuaccagagaaacacacguugugguacauuaccuggua

SEQ ID NO: 4435 - DNA, 54 bp; single-stranded, linear
guaguauaagaaggggccaccagagaaacacacguugugguacauuaccuggua

SEQ ID NO: 4436 - DNA, 54 bp; single-stranded, linear
ccagcaugagaagguacaaccagagaaacacacguugugguacauuaccuggua

SEQ ID NO: 4437 - DNA, 54 bp; single-stranded, linear
cccgugccagaaguccagaccagagaaacacacguugugguacauuaccuggua

SEQ ID NO: 4438 - DNA, 54 bp; single-stranded, linear
gugagguaagaagagagaaccagagaaacacacguugugguacauuaccuggua

SEQ ID NO: 4439 - DNA, 54 bp; single-stranded, linear
auacaggaagaaggugagaccagagaaacacacguugugguacauuaccuggua

SEQ ID NO: 4440 - DNA, 54 bp; single-stranded, linear
cacucacaagaaggcucuaccagagaaacacacguugugguacauuaccuggua

SEQ ID NO: 4441 - DNA, 54 bp; single-stranded, linear
ugguugucagaagggauuaccagagaaacacacguugugguacauuaccuggua

SEQ ID NO: 4442 - DNA, 54 bp; single-stranded, linear
cacuguccagaagguuguaccagagaaacacacguugugguacauuaccuggua

SEQ ID NO: 4443 - DNA, 54 bp; single-stranded, linear
gauauccgagaagguagcaccagagaaacacacguugugguacauuaccuggua

SEQ ID NO: 4444 - DNA, 54 bp; single-stranded, linear
ucugugucagaagagugaaccagagaaacacacguugugguacauuaccuggua

SEQ ID NO: 4445 - DNA, 54 bp; single-stranded, linear
agaaucugagaagugcuaaccagagaaacacacguugugguacauuaccuggua

SEQ ID NO: 4446 - DNA, 54 bp; single-stranded, linear
gcuggagaagaagggcugaccagagaaacacacguugugguacauuaccuggua

SEQ ID NO: 4447 - DNA, 54 bp; single-stranded, linear
ccgugucaagaaggagaaaccagagaaacacacguugugguacauuaccuggua

SEQ ID NO: 4448 - DNA, 54 bp; single-stranded, linear
uccuuuuaagaaggaggaaccagagaaacacacguugugguacauuaccuggua

SEQ ID NO: 4449 - DNA, 54 bp; single-stranded, linear
aaaaucugagaagaccucaccagagaaacacacguugugguacauuaccuggua

SEQ ID NO: 4450 - DNA, 54 bp; single-stranded, linear
acuucaaaagaagagcagaccagagaaacacacguugugguacauuaccuggua

SEQ ID NO: 4451 - DNA, 54 bp; single-stranded, linear
ucccugcaagaagaggucaccagagaaacacacguugugguacauuaccuggua

SEQ ID NO: 4452 - DNA, 54 bp; single-stranded, linear
ccuagaagagaaggcuccaccagagaaacacacguugugguacauuaccuggua

SEQ ID NO: 4453 - DNA, 18 bp; single-stranded, linear
aggugcugcuggccgucg

SEQ ID NO: 4454 - DNA, 18 bp; single-stranded, linear
gcuggccgucgcccugug

SEQ ID NO: 4455 - DNA, 18 bp; single-stranded, linear
ccgggccgccucuguggg

SEQ ID NO: 4456 - DNA, 18 bp; single-stranded, linear
uugaucugcccaggcuca

SEQ ID NO: 4457 - DNA, 18 bp; single-stranded, linear
ggaaacugacuuggccuc

SEQ ID NO: 4458 - DNA, 18 bp; single-stranded, linear
gauuacagaucuccauuu

SEQ ID NO: 4459 - DNA, 18 bp; single-stranded, linear
uguuccugaugguaacag

SEQ ID NO: 4460 - DNA, 18 bp; single-stranded, linear
guuaccagucuauuaugu

SEQ ID NO: 4461 - DNA, 18 bp; single-stranded, linear
ugaguccgucucauggaa

SEQ ID NO: 4462 - DNA, 18 bp; single-stranded, linear
acuaucuguuggagaaaa

SEQ ID NO: 4463 - DNA, 18 bp; single-stranded, linear
aaacccagucugggagug

SEQ ID NO: 4464 - DNA, 18 bp; single-stranded, linear
gugggcugaugaccaaga

SEQ ID NO: 4465 - DNA, 18 bp; single-stranded, linear
auguacugacgauuaugg

SEQ ID NO: 4466 - DNA, 18 bp; single-stranded, linear
caccccagauuggugaga

SEQ ID NO: 4467 - DNA, 18 bp; single-stranded, linear
auguacggucuaugccau

SEQ ID NO: 4468 - DNA, 18 bp; single-stranded, linear
auuggcaguuggaggaag

SEQ ID NO: 4469 - DNA, 18 bp; single-stranded, linear
ccaagcugucucagugac

SEQ ID NO: 4470 - DNA, 18 bp; single-stranded, linear
ugugucagcuuuguacaa

SEQ ID NO: 4471 - DNA, 18 bp; single-stranded, linear
acaugcagcccacugagc

SEQ ID NO: 4472 - DNA, 18 bp; single-stranded, linear
gcagacagaucuacguuu

SEQ ID NO: 4473 - DNA, 18 bp; single-stranded, linear
gcccacagccucugccaa

SEQ ID NO: 4474 - DNA, 18 bp; single-stranded, linear
cacaccuguuugcaagaa

SEQ ID NO: 4475 - DNA, 18 bp; single-stranded, linear
uaugucugccuugcucaa

SEQ ID NO: 4476 - DNA, 18 bp; single-stranded, linear
ucaggcagcucacagucc

SEQ ID NO: 4477 - DNA, 18 bp; single-stranded, linear
gcucacaguccuagagcg

SEQ ID NO: 4478 - DNA, 18 bp; single-stranded, linear
agaaucagacgacaagua

SEQ ID NO: 4479 - DNA, 18 bp; single-stranded, linear
cuccacagaucauguggu

SEQ ID NO: 4480 - DNA, 18 bp; single-stranded, linear
ggauccagaugaacuccc

SEQ ID NO: 4481 - DNA, 18 bp; single-stranded, linear
aacgacugccuuaugaug

SEQ ID NO: 4482 - DNA, 18 bp; single-stranded, linear
gagaccggcugaaccuag

SEQ ID NO: 4483 - DNA, 18 bp; single-stranded, linear
ugaagcagaugccuuugg

SEQ ID NO: 4484 - DNA, 18 bp; single-stranded, linear
gaaaccuguccacuuacc

SEQ ID NO: 4485 - DNA, 18 bp; single-stranded, linear
ucagccagcucuggauuu

SEQ ID NO: 4486 - DNA, 18 bp; single-stranded, linear
acuuccugaccuuggagc

SEQ ID NO: 4487 - DNA, 18 bp; single-stranded, linear
uguuacagcuuccaagug

SEQ ID NO: 4488 - DNA, 18 bp; single-stranded, linear
agauccagauuaugucag

SEQ ID NO: 4489 - DNA, 18 bp; single-stranded, linear
ggccccugauuauacuac

SEQ ID NO: 4490 - DNA, 18 bp; single-stranded, linear
uguaccagaccaugcugg

SEQ ID NO: 4491 - DNA, 18 bp; single-stranded, linear
cuggacugcuggcacggg

SEQ ID NO: 4492 - DNA, 18 bp; single-stranded, linear
ucucucugccuaccucac

SEQ ID NO: 4493 - DNA, 18 bp; single-stranded, linear
cucaccuguuuccuguau

SEQ ID NO: 4494 - DNA, 18 bp; single-stranded, linear
agagccggccugugagug

SEQ ID NO: 4495 - DNA, 18 bp; single-stranded, linear
aaucccagaugacaacca

SEQ ID NO: 4496 - DNA, 18 bp; single-stranded, linear
acaaccagacggacagug

SEQ ID NO: 4497 - DNA, 18 bp; single-stranded, linear
gcuaccaguccggauauc

SEQ ID NO: 4498 - DNA, 18 bp; single-stranded, linear
ucacuccgaugacacaga

SEQ ID NO: 4499 - DNA, 18 bp; single-stranded, linear
uagcacagcccagauucu

SEQ ID NO: 4500 - DNA, 18 bp; single-stranded, linear
cagcccagauucuccagc

SEQ ID NO: 4501 - DNA, 18 bp; single-stranded, linear
uucuccagccugacacgg

SEQ ID NO: 4502 - DNA, 18 bp; single-stranded, linear
uccuccuguuuaaaagga

SEQ ID NO: 4503 - DNA, 18 bp; single-stranded, linear
gaggucugcucagauuuu

SEQ ID NO: 4504 - DNA, 18 bp; single-stranded, linear
cugcucagauuuugaagu

SEQ ID NO: 4505 - DNA, 18 bp; single-stranded, linear
gaccucggacugcaggga

SEQ ID NO: 4506 - DNA, 18 bp; single-stranded, linear
ggagccagcucuucuagg

SEQ ID NO: 4507 - DNA, 27 bp; single-stranded, linear
  The letter "N" represents the stem II region of an HH ribozyme.
ccguaccccugaugangaaauucgccc

SEQ ID NO: 4508 - DNA, 27 bp; single-stranded, linear
  The letter "N" represents the stem II region of an HH ribozyme.
gggucccgcugaugangaaacccaauu

SEQ ID NO: 4509 - DNA, 27 bp; single-stranded, linear
  The letter "N" represents the stem II region of an HH ribozyme.
ucgaccuccugaugangaaaggggggu

SEQ ID NO: 4510 - DNA, 27 bp; single-stranded, linear
  The letter "N" represents the stem II region of an HH ribozyme.
auaccguccugaugangaaaccucgag

SEQ ID NO: 4511 - DNA, 27 bp; single-stranded, linear
  The letter "N" represents the stem II region of an HH ribozyme.
cuuaucgacugaugangaaaccgucga

SEQ ID NO: 4512 - DNA, 27 bp; single-stranded, linear
  The letter "N" represents the stem II region of an HH ribozyme.
agcuuauccugaugangaaauaccguc

SEQ ID NO: 4513 - DNA, 27 bp; single-stranded, linear
  The letter "N" represents the stem II region of an HH ribozyme.
aucaagcucugaugangaaaucgauac

SEQ ID NO: 4514 - DNA, 27 bp; single-stranded, linear
  The letter "N" represents the stem II region of an HH ribozyme.
ucgauauccugaugangaaagcuuauc

SEQ ID NO: 4515 - DNA, 27 bp; single-stranded, linear
  The letter "N" represents the stem II region of an HH ribozyme.
gaauucgacugaugangaaaucaagcu

SEQ ID NO: 4516 - DNA, 27 bp; single-stranded, linear
  The letter "N" represents the stem II region of an HH ribozyme.
ccgaauuccugaugangaaauaucaag

SEQ ID NO: 4517 - DNA, 27 bp; single-stranded, linear
  The letter "N" represents the stem II region of an HH ribozyme.
ugggcccgcugaugangaaauucgaua

SEQ ID NO: 4518 - DNA, 27 bp; single-stranded, linear
  The letter "N" represents the stem II region of an HH ribozyme.
cugggccccugaugangaaaauucgau

SEQ ID NO: 4519 - DNA, 27 bp; single-stranded, linear
  The letter "N" represents the stem II region of an HH ribozyme.
ggcugcggcugaugangaaacacaguc

SEQ ID NO: 4520 - DNA, 27 bp; single-stranded, linear
  The letter "N" represents the stem II region of an HH ribozyme.
agccaggucugaugangaaaucccggc

SEQ ID NO: 4521 - DNA, 27 bp; single-stranded, linear
  The letter "N" represents the stem II region of an HH ribozyme.
guccgcggcugaugangaaaucggguc

SEQ ID NO: 4522 - DNA, 27 bp; single-stranded, linear
  The letter "N" represents the stem II region of an HH ribozyme.
uguccgcgcugaugangaaaaucgggu

SEQ ID NO: 4523 - DNA, 27 bp; single-stranded, linear
  The letter "N" represents the stem II region of an HH ribozyme.
accggggacugaugangaaagcgcggg

SEQ ID NO: 4524 - DNA, 27 bp; single-stranded, linear
  The letter "N" represents the stem II region of an HH ribozyme.
agaccgggcugaugangaaagagcgcg

SEQ ID NO: 4525 - DNA, 27 bp; single-stranded, linear
  The letter "N" represents the stem II region of an HH ribozyme.
cagcgcaacugaugangaaaccgggga

SEQ ID NO: 4526 - DNA, 27 bp; single-stranded, linear
  The letter "N" represents the stem II region of an HH ribozyme.
cgcagcgccugaugangaaagaccggg

SEQ ID NO: 4527 - DNA, 27 bp; single-stranded, linear
  The letter "N" represents the stem II region of an HH ribozyme.
agaggcggcugaugangaaauggcccc

SEQ ID NO: 4528 - DNA, 27 bp; single-stranded, linear
  The letter "N" represents the stem II region of an HH ribozyme.
aagucacacugaugangaaaggcggua

SEQ ID NO: 4529 - DNA, 27 bp; single-stranded, linear
  The letter "N" represents the stem II region of an HH ribozyme.
ccgcaaagcugaugangaaagucacag

SEQ ID NO: 4530 - DNA, 27 bp; single-stranded, linear
  The letter "N" represents the stem II region of an HH ribozyme.
cccgcaaacugaugangaaaagucaca

SEQ ID NO: 4531 - DNA, 27 bp; single-stranded, linear
  The letter "N" represents the stem II region of an HH ribozyme.
ggcccgcacugaugangaaagaaguca

SEQ ID NO: 4532 - DNA, 27 bp; single-stranded, linear
  The letter "N" represents the stem II region of an HH ribozyme.
uggcccgccugaugangaaaagaaguc

SEQ ID NO: 4533 - DNA, 27 bp; single-stranded, linear
  The letter "N" represents the stem II region of an HH ribozyme.
caggcacacugaugangaaacuccuuc

SEQ ID NO: 4534 - DNA, 27 bp; single-stranded, linear
  The letter "N" represents the stem II region of an HH ribozyme.
ugggcacacugaugangaaagcccagu

SEQ ID NO: 4535 - DNA, 27 bp; single-stranded, linear
  The letter "N" represents the stem II region of an HH ribozyme.
gcgacagccugaugangaaagcagcgc

SEQ ID NO: 4536 - DNA, 27 bp; single-stranded, linear
  The letter "N" represents the stem II region of an HH ribozyme.
cacagagccugaugangaaacagcuag

SEQ ID NO: 4537 - DNA, 27 bp; single-stranded, linear
  The letter "N" represents the stem II region of an HH ribozyme.
gaaccacacugaugangaaagcgacag

SEQ ID NO: 4538 - DNA, 27 bp; single-stranded, linear
  The letter "N" represents the stem II region of an HH ribozyme.
ccacgcagcugaugangaaaccacaga

SEQ ID NO: 4539 - DNA, 27 bp; single-stranded, linear
  The letter "N" represents the stem II region of an HH ribozyme.
uccacgcacugaugangaaaaccacag

SEQ ID NO: 4540 - DNA, 27 bp; single-stranded, linear
  The letter "N" represents the stem II region of an HH ribozyme.
aacccacacugaugangaaaggcggcu

SEQ ID NO: 4541 - DNA, 27 bp; single-stranded, linear
  The letter "N" represents the stem II region of an HH ribozyme.
gccagucacugaugangaaacccacag

SEQ ID NO: 4542 - DNA, 27 bp; single-stranded, linear
  The letter "N" represents the stem II region of an HH ribozyme.
cgccaguccugaugangaaaacccaca

SEQ ID NO: 4543 - DNA, 27 bp; single-stranded, linear
  The letter "N" represents the stem II region of an HH ribozyme.
auggagaacugaugangaaaucgccag

SEQ ID NO: 4544 - DNA, 27 bp; single-stranded, linear
  The letter "N" represents the stem II region of an HH ribozyme.
gauggagacugaugangaaaaucgcca

SEQ ID NO: 4545 - DNA, 27 bp; single-stranded, linear
  The letter "N" represents the stem II region of an HH ribozyme.
ggauggagcugaugangaaaaaucgcc

SEQ ID NO: 4546 - DNA, 27 bp; single-stranded, linear
  The letter "N" represents the stem II region of an HH ribozyme.
gggauggacugaugangaaaaaaucgc

SEQ ID NO: 4547 - DNA, 27 bp; single-stranded, linear
  The letter "N" represents the stem II region of an HH ribozyme.
gggggaugcugaugangaaagaaaauc

SEQ ID NO: 4548 - DNA, 27 bp; single-stranded, linear
  The letter "N" represents the stem II region of an HH ribozyme.
cuugggggcugaugangaaauggagaa

SEQ ID NO: 4549 - DNA, 27 bp; single-stranded, linear
  The letter "N" represents the stem II region of an HH ribozyme.
ugugugcucugaugangaaagcuuggg

SEQ ID NO: 4550 - DNA, 27 bp; single-stranded, linear
  The letter "N" represents the stem II region of an HH ribozyme.
auugucagcugaugangaaaugucuuu

SEQ ID NO: 4551 - DNA, 27 bp; single-stranded, linear
  The letter "N" represents the stem II region of an HH ribozyme.
uuugccaacugaugangaaauugucag

SEQ ID NO: 4552 - DNA, 27 bp; single-stranded, linear
  The letter "N" represents the stem II region of an HH ribozyme.
auuugccacugaugangaaaauuguca

SEQ ID NO: 4553 - DNA, 27 bp; single-stranded, linear
  The letter "N" represents the stem II region of an HH ribozyme.
uauuugcccugaugangaaaaauuguc

SEQ ID NO: 4554 - DNA, 27 bp; single-stranded, linear
  The letter "N" represents the stem II region of an HH ribozyme.
aaggguugcugaugangaaauuugcca

SEQ ID NO: 4555 - DNA, 27 bp; single-stranded, linear
  The letter "N" represents the stem II region of an HH ribozyme.
guaaucugcugaugangaaaggguugu

SEQ ID NO: 4556 - DNA, 27 bp; single-stranded, linear
  The letter "N" represents the stem II region of an HH ribozyme.
aguaaucucugaugangaaaaggguug

SEQ ID NO: 4557 - DNA, 27 bp; single-stranded, linear
  The letter "N" represents the stem II region of an HH ribozyme.
cugcaagucugaugangaaaucugaag

SEQ ID NO: 4558 - DNA, 27 bp; single-stranded, linear
  The letter "N" represents the stem II region of an HH ribozyme.
ccugcaagcugaugangaaaaucugaa

SEQ ID NO: 4559 - DNA, 27 bp; single-stranded, linear
  The letter "N" represents the stem II region of an HH ribozyme.
uccccugccugaugangaaaguaaucu

SEQ ID NO: 4560 - DNA, 27 bp; single-stranded, linear
  The letter "N" represents the stem II region of an HH ribozyme.
uugggccacugaugangaaagccaguc

SEQ ID NO: 4561 - DNA, 27 bp; single-stranded, linear
  The letter "N" represents the stem II region of an HH ribozyme.
auugggcccugaugangaaaagccagu

SEQ ID NO: 4562 - DNA, 27 bp; single-stranded, linear
  The letter "N" represents the stem II region of an HH ribozyme.
aucacgcucugaugangaaagcauugg

SEQ ID NO: 4563 - DNA, 27 bp; single-stranded, linear
  The letter "N" represents the stem II region of an HH ribozyme.
uuccucagcugaugangaaaucacgcu

SEQ ID NO: 4564 - DNA, 27 bp; single-stranded, linear
  The letter "N" represents the stem II region of an HH ribozyme.
uuuccucacugaugangaaaaucacgc

SEQ ID NO: 4565 - DNA, 27 bp; single-stranded, linear
  The letter "N" represents the stem II region of an HH ribozyme.
gucaccaacugaugangaaacccuuuc

SEQ ID NO: 4566 - DNA, 27 bp; single-stranded, linear
  The letter "N" represents the stem II region of an HH ribozyme.
cagucacccugaugangaaauacccuu

SEQ ID NO: 4567 - DNA, 27 bp; single-stranded, linear
  The letter "N" represents the stem II region of an HH ribozyme.
gcagaagacugaugangaaacugucac

SEQ ID NO: 4568 - DNA, 27 bp; single-stranded, linear
  The letter "N" represents the stem II region of an HH ribozyme.
uugcagaacugaugangaaauacuguc

SEQ ID NO: 4569 - DNA, 27 bp; single-stranded, linear
  The letter "N" represents the stem II region of an HH ribozyme.
uuuugcagcugaugangaaagauacug

SEQ ID NO: 4570 - DNA, 27 bp; single-stranded, linear
  The letter "N" represents the stem II region of an HH ribozyme.
guuuugcacugaugangaaaagauacu

SEQ ID NO: 4571 - DNA, 27 bp; single-stranded, linear
  The letter "N" represents the stem II region of an HH ribozyme.
ggaauggucugaugangaaaguguuuu

SEQ ID NO: 4572 - DNA, 27 bp; single-stranded, linear
  The letter "N" represents the stem II region of an HH ribozyme.
acccugggcugaugangaaauggugag

SEQ ID NO: 4573 - DNA, 27 bp; single-stranded, linear
  The letter "N" represents the stem II region of an HH ribozyme.
cacccuggcugaugangaaaaugguga

SEQ ID NO: 4574 - DNA, 27 bp; single-stranded, linear
  The letter "N" represents the stem II region of an HH ribozyme.
ucauuucccugaugangaaaccacccu

SEQ ID NO: 4575 - DNA, 27 bp; single-stranded, linear
  The letter "N" represents the stem II region of an HH ribozyme.
ggcuccagcugaugangaaaucauuuc

SEQ ID NO: 4576 - DNA, 27 bp; single-stranded, linear
  The letter "N" represents the stem II region of an HH ribozyme.
agcacuugcugaugangaaaggcucca

SEQ ID NO: 4577 - DNA, 27 bp; single-stranded, linear
  The letter "N" represents the stem II region of an HH ribozyme.
cccgguaccugaugangaaagcacuug

SEQ ID NO: 4578 - DNA, 27 bp; single-stranded, linear
  The letter "N" represents the stem II region of an HH ribozyme.
cgucccggcugaugangaaacgagcac

SEQ ID NO: 4579 - DNA, 27 bp; single-stranded, linear
  The letter "N" represents the stem II region of an HH ribozyme.
gcuauguccugaugangaaacgucccg

SEQ ID NO: 4580 - DNA, 27 bp; single-stranded, linear
  The letter "N" represents the stem II region of an HH ribozyme.
guggaggccugaugangaaaugucgac

SEQ ID NO: 4581 - DNA, 27 bp; single-stranded, linear
  The letter "N" represents the stem II region of an HH ribozyme.
aaacagugcugaugangaaaggcuaug

SEQ ID NO: 4582 - DNA, 27 bp; single-stranded, linear
  The letter "N" represents the stem II region of an HH ribozyme.
uagacauacugaugangaaacagugga

SEQ ID NO: 4583 - DNA, 27 bp; single-stranded, linear
  The letter "N" represents the stem II region of an HH ribozyme.
auagacaucugaugangaaaacagugg

SEQ ID NO: 4584 - DNA, 27 bp; single-stranded, linear
  The letter "N" represents the stem II region of an HH ribozyme.
cauagacacugaugangaaaaacagug

SEQ ID NO: 4585 - DNA, 27 bp; single-stranded, linear
  The letter "N" represents the stem II region of an HH ribozyme.
cgaacauacugaugangaaacauaaac

SEQ ID NO: 4586 - DNA, 27 bp; single-stranded, linear
  The letter "N" represents the stem II region of an HH ribozyme.
cucgaacacugaugangaaagacauaa

SEQ ID NO: 4587 - DNA, 27 bp; single-stranded, linear
  The letter "N" represents the stem II region of an HH ribozyme.
uaaucucgcugaugangaaacauagac

SEQ ID NO: 4588 - DNA, 27 bp; single-stranded, linear
  The letter "N" represents the stem II region of an HH ribozyme.
guaaucuccugaugangaaaacauaga

SEQ ID NO: 4589 - DNA, 27 bp; single-stranded, linear
  The letter "N" represents the stem II region of an HH ribozyme.
ugaucugucugaugangaaaucucgaa

SEQ ID NO: 4590 - DNA, 27 bp; single-stranded, linear
  The letter "N" represents the stem II region of an HH ribozyme.
gugaucugcugaugangaaaaucucga

SEQ ID NO: 4591 - DNA, 27 bp; single-stranded, linear
  The letter "N" represents the stem II region of an HH ribozyme.
ugaauggucugaugangaaaucuguaa

SEQ ID NO: 4592 - DNA, 27 bp; single-stranded, linear
  The letter "N" represents the stem II region of an HH ribozyme.
aggcgaugcugaugangaaauggugau

SEQ ID NO: 4593 - DNA, 27 bp; single-stranded, linear
  The letter "N" represents the stem II region of an HH ribozyme.
gaggcgaucugaugangaaaaugguga

SEQ ID NO: 4594 - DNA, 27 bp; single-stranded, linear
  The letter "N" represents the stem II region of an HH ribozyme.
acagaggccugaugangaaaugaaugg

SEQ ID NO: 4595 - DNA, 27 bp; single-stranded, linear
  The letter "N" represents the stem II region of an HH ribozyme.
cacugacacugaugangaaaggcgaug

SEQ ID NO: 4596 - DNA, 27 bp; single-stranded, linear
  The letter "N" represents the stem II region of an HH ribozyme.
uggucacucugaugangaaacagaggc

SEQ ID NO: 4597 - DNA, 27 bp; single-stranded, linear
  The letter "N" represents the stem II region of an HH ribozyme.
auguacaccugaugangaaaugccaug

SEQ ID NO: 4598 - DNA, 27 bp; single-stranded, linear
  The letter "N" represents the stem II region of an HH ribozyme.
cggugaugcugaugangaaacacgaug

SEQ ID NO: 4599 - DNA, 27 bp; single-stranded, linear
  The letter "N" represents the stem II region of an HH ribozyme.
uucucggucugaugangaaauguacac

SEQ ID NO: 4600 - DNA, 27 bp; single-stranded, linear
  The letter "N" represents the stem II region of an HH ribozyme.
cggcagggcugaugangaaaucaccac

SEQ ID NO: 4601 - DNA, 27 bp; single-stranded, linear
  The letter "N" represents the stem II region of an HH ribozyme.
uugaaauccugaugangaaacccucgg

SEQ ID NO: 4602 - DNA, 27 bp; single-stranded, linear
  The letter "N" represents the stem II region of an HH ribozyme.
agguuugacugaugangaaaucgaccc

SEQ ID NO: 4603 - DNA, 27 bp; single-stranded, linear
  The letter "N" represents the stem II region of an HH ribozyme.
gagguuugcugaugangaaaaucgacc

SEQ ID NO: 4604 - DNA, 27 bp; single-stranded, linear
  The letter "N" represents the stem II region of an HH ribozyme.
ugagguuucugaugangaaaaaucgac

SEQ ID NO: 4605 - DNA, 27 bp; single-stranded, linear
  The letter "N" represents the stem II region of an HH ribozyme.
gacacauucugaugangaaagguuuga

SEQ ID NO: 4606 - DNA, 27 bp; single-stranded, linear
  The letter "N" represents the stem II region of an HH ribozyme.
cgcaaagacugaugangaaacacauug

SEQ ID NO: 4607 - DNA, 27 bp; single-stranded, linear
  The letter "N" represents the stem II region of an HH ribozyme.
agcgcaaacugaugangaaagacacau

SEQ ID NO: 4608 - DNA, 27 bp; single-stranded, linear
  The letter "N" represents the stem II region of an HH ribozyme.
cuagcgcacugaugangaaagagacac

SEQ ID NO: 4609 - DNA, 27 bp; single-stranded, linear
  The letter "N" represents the stem II region of an HH ribozyme.
ccuagcgccugaugangaaaagagaca

SEQ ID NO: 4610 - DNA, 27 bp; single-stranded, linear
  The letter "N" represents the stem II region of an HH ribozyme.
uggauacccugaugangaaagcgcaaa

SEQ ID NO: 4611 - DNA, 27 bp; single-stranded, linear
  The letter "N" represents the stem II region of an HH ribozyme.
uuucuggacugaugangaaaccuagcg

SEQ ID NO: 4612 - DNA, 27 bp; single-stranded, linear
  The letter "N" represents the stem II region of an HH ribozyme.
cuuuucugcugaugangaaauaccuag

SEQ ID NO: 4613 - DNA, 27 bp; single-stranded, linear
  The letter "N" represents the stem II region of an HH ribozyme.
ccggaacacugaugangaaaucucuuu

SEQ ID NO: 4614 - DNA, 27 bp; single-stranded, linear
  The letter "N" represents the stem II region of an HH ribozyme.
uccggaaccugaugangaaaaucucuu

SEQ ID NO: 4615 - DNA, 27 bp; single-stranded, linear
  The letter "N" represents the stem II region of an HH ribozyme.
ccauccggcugaugangaaacaaaucu

SEQ ID NO: 4616 - DNA, 27 bp; single-stranded, linear
  The letter "N" represents the stem II region of an HH ribozyme.
uccauccgcugaugangaaaacaaauc

SEQ ID NO: 4617 - DNA, 27 bp; single-stranded, linear
  The letter "N" represents the stem II region of an HH ribozyme.
ucccaggacugaugangaaauucuguu

SEQ ID NO: 4618 - DNA, 27 bp; single-stranded, linear
  The letter "N" represents the stem II region of an HH ribozyme.
gucccaggcugaugangaaaauucugu

SEQ ID NO: 4619 - DNA, 27 bp; single-stranded, linear
  The letter "N" represents the stem II region of an HH ribozyme.
ugucccagcugaugangaaaaauucug

SEQ ID NO: 4620 - DNA, 27 bp; single-stranded, linear
  The letter "N" represents the stem II region of an HH ribozyme.
guaaagcccugaugangaaaucucgcu

SEQ ID NO: 4621 - DNA, 27 bp; single-stranded, linear
  The letter "N" represents the stem II region of an HH ribozyme.
ggagaguacugaugangaaagccuauc

SEQ ID NO: 4622 - DNA, 27 bp; single-stranded, linear
  The letter "N" represents the stem II region of an HH ribozyme.
gggagagucugaugangaaaagccuau

SEQ ID NO: 4623 - DNA, 27 bp; single-stranded, linear
  The letter "N" represents the stem II region of an HH ribozyme.
ggggagagcugaugangaaaaagccua

SEQ ID NO: 4624 - DNA, 27 bp; single-stranded, linear
  The letter "N" represents the stem II region of an HH ribozyme.
acuggggacugaugangaaaguaaagc

SEQ ID NO: 4625 - DNA, 27 bp; single-stranded, linear
  The letter "N" represents the stem II region of an HH ribozyme.
uaacugggcugaugangaaagaguaaa

SEQ ID NO: 4626 - DNA, 27 bp; single-stranded, linear
  The letter "N" represents the stem II region of an HH ribozyme.
gaucaugucugaugangaaacugggga

SEQ ID NO: 4627 - DNA, 27 bp; single-stranded, linear
  The letter "N" represents the stem II region of an HH ribozyme.
ugaucaugcugaugangaaaacugggg

SEQ ID NO: 4628 - DNA, 27 bp; single-stranded, linear
  The letter "N" represents the stem II region of an HH ribozyme.
gcauagcucugaugangaaaucaugua

SEQ ID NO: 4629 - DNA, 27 bp; single-stranded, linear
  The letter "N" represents the stem II region of an HH ribozyme.
ugccggcacugaugangaaagcugauc

SEQ ID NO: 4630 - DNA, 27 bp; single-stranded, linear
  The letter "N" represents the stem II region of an HH ribozyme.
ucacagaacugaugangaaaccaugcc

SEQ ID NO: 4631 - DNA, 27 bp; single-stranded, linear
  The letter "N" represents the stem II region of an HH ribozyme.
ccucacagcugaugangaaagaccaug

SEQ ID NO: 4632 - DNA, 27 bp; single-stranded, linear
  The letter "N" represents the stem II region of an HH ribozyme.
gccucacacugaugangaaaagaccau

SEQ ID NO: 4633 - DNA, 27 bp; single-stranded, linear
  The letter "N" represents the stem II region of an HH ribozyme.
ucaucauucugaugangaaaucuuugc

SEQ ID NO: 4634 - DNA, 27 bp; single-stranded, linear
  The letter "N" represents the stem II region of an HH ribozyme.
uagacugacugaugangaaagguuuca

SEQ ID NO: 4635 - DNA, 27 bp; single-stranded, linear
  The letter "N" represents the stem II region of an HH ribozyme.
gauagacucugaugangaaauagguuu

SEQ ID NO: 4636 - DNA, 27 bp; single-stranded, linear
  The letter "N" represents the stem II region of an HH ribozyme.
acaugauacugaugangaaacugauag

SEQ ID NO: 4637 - DNA, 27 bp; single-stranded, linear
  The letter "N" represents the stem II region of an HH ribozyme.
guacaugacugaugangaaagacugau

SEQ ID NO: 4638 - DNA, 27 bp; single-stranded, linear
  The letter "N" represents the stem II region of an HH ribozyme.
auguacaucugaugangaaauagacug

SEQ ID NO: 4639 - DNA, 27 bp; single-stranded, linear
  The letter "N" represents the stem II region of an HH ribozyme.
caacuaugcugaugangaaacaugaua

SEQ ID NO: 4640 - DNA, 27 bp; single-stranded, linear
  The letter "N" represents the stem II region of an HH ribozyme.
accacaaccugaugangaaauguacau

SEQ ID NO: 4641 - DNA, 27 bp; single-stranded, linear
  The letter "N" represents the stem II region of an HH ribozyme.
acaaccaccugaugangaaacuaugua

SEQ ID NO: 4642 - DNA, 27 bp; single-stranded, linear
  The letter "N" represents the stem II region of an HH ribozyme.
uauccuaccugaugangaaaccacaac

SEQ ID NO: 4643 - DNA, 27 bp; single-stranded, linear
  The letter "N" represents the stem II region of an HH ribozyme.
cuauaucccugaugangaaacaaccac

SEQ ID NO: 4644 - DNA, 27 bp; single-stranded, linear
  The letter "N" represents the stem II region of an HH ribozyme.
aaauccuacugaugangaaauccuaca

SEQ ID NO: 4645 - DNA, 27 bp; single-stranded, linear
  The letter "N" represents the stem II region of an HH ribozyme.
auaaaucccugaugangaaauauccua

SEQ ID NO: 4646 - DNA, 27 bp; single-stranded, linear
  The letter "N" represents the stem II region of an HH ribozyme.
acaucauacugaugangaaauccuaua

SEQ ID NO: 4647 - DNA, 27 bp; single-stranded, linear
  The letter "N" represents the stem II region of an HH ribozyme.
cacaucaucugaugangaaaauccuau

SEQ ID NO: 4648 - DNA, 27 bp; single-stranded, linear
  The letter "N" represents the stem II region of an HH ribozyme.
ucacaucacugaugangaaaaauccua

SEQ ID NO: 4649 - DNA, 27 bp; single-stranded, linear
  The letter "N" represents the stem II region of an HH ribozyme.
gggcucagcugaugangaaaucacauc

SEQ ID NO: 4650 - DNA, 27 bp; single-stranded, linear
  The letter "N" represents the stem II region of an HH ribozyme.
ggggcucacugaugangaaaaucacau

SEQ ID NO: 4651 - DNA, 27 bp; single-stranded, linear
  The letter "N" represents the stem II region of an HH ribozyme.
gauagcuccugaugangaaauuucaug

SEQ ID NO: 4652 - DNA, 27 bp; single-stranded, linear
  The letter "N" represents the stem II region of an HH ribozyme.
ccggcagacugaugangaaagcucaau

SEQ ID NO: 4653 - DNA, 27 bp; single-stranded, linear
  The letter "N" represents the stem II region of an HH ribozyme.
cuccggcacugaugangaaauagcuca

SEQ ID NO: 4654 - DNA, 27 bp; single-stranded, linear
  The letter "N" represents the stem II region of an HH ribozyme.
uuuaagaccugaugangaaaguuuuuc

SEQ ID NO: 4655 - DNA, 27 bp; single-stranded, linear
  The letter "N" represents the stem II region of an HH ribozyme.
caauuuaacugaugangaaacaaguuu

SEQ ID NO: 4656 - DNA, 27 bp; single-stranded, linear
  The letter "N" represents the stem II region of an HH ribozyme.
uacaauuucugaugangaaagacaagu

SEQ ID NO: 4657 - DNA, 27 bp; single-stranded, linear
  The letter "N" represents the stem II region of an HH ribozyme.
guacaauucugaugangaaaagacaag

SEQ ID NO: 4658 - DNA, 27 bp; single-stranded, linear
  The letter "N" represents the stem II region of an HH ribozyme.
cgcuguaccugaugangaaauuuaaga

SEQ ID NO: 4659 - DNA, 27 bp; single-stranded, linear
  The letter "N" represents the stem II region of an HH ribozyme.
ucucgcugcugaugangaaacaauuua

SEQ ID NO: 4660 - DNA, 27 bp; single-stranded, linear
  The letter "N" represents the stem II region of an HH ribozyme.
cccacauucugaugangaaagcucugu

SEQ ID NO: 4661 - DNA, 27 bp; single-stranded, linear
  The letter "N" represents the stem II region of an HH ribozyme.
gugaaauccugaugangaaagccccac

SEQ ID NO: 4662 - DNA, 27 bp; single-stranded, linear
  The letter "N" represents the stem II region of an HH ribozyme.
ccaggugacugaugangaaaucaagcc

SEQ ID NO: 4663 - DNA, 27 bp; single-stranded, linear
  The letter "N" represents the stem II region of an HH ribozyme.
gccaggugcugaugangaaaaucaagc

SEQ ID NO: 4664 - DNA, 27 bp; single-stranded, linear
  The letter "N" represents the stem II region of an HH ribozyme.
ugccaggucugaugangaaaaaucaag

SEQ ID NO: 4665 - DNA, 27 bp; single-stranded, linear
  The letter "N" represents the stem II region of an HH ribozyme.
aagguggacugaugangaaagugccag

SEQ ID NO: 4666 - DNA, 27 bp; single-stranded, linear
  The letter "N" represents the stem II region of an HH ribozyme.
ugaaggugcugaugangaaagagugcc

SEQ ID NO: 4667 - DNA, 27 bp; single-stranded, linear
  The letter "N" represents the stem II region of an HH ribozyme.
agacuuugcugaugangaaagguggag

SEQ ID NO: 4668 - DNA, 27 bp; single-stranded, linear
  The letter "N" represents the stem II region of an HH ribozyme.
gagacuuucugaugangaaaaggugga

SEQ ID NO: 4669 - DNA, 27 bp; single-stranded, linear
  The letter "N" represents the stem II region of an HH ribozyme.
uaugaugacugaugangaaacuuugaa

SEQ ID NO: 4670 - DNA, 27 bp; single-stranded, linear
  The letter "N" represents the stem II region of an HH ribozyme.
cuuaugaucugaugangaaagacuuug

SEQ ID NO: 4671 - DNA, 27 bp; single-stranded, linear
  The letter "N" represents the stem II region of an HH ribozyme.
cuucuuaucugaugangaaaugagacu

SEQ ID NO: 4672 - DNA, 27 bp; single-stranded, linear
  The letter "N" represents the stem II region of an HH ribozyme.
aaucuucucugaugangaaaugaugag

SEQ ID NO: 4673 - DNA, 27 bp; single-stranded, linear
  The letter "N" represents the stem II region of an HH ribozyme.
cgguuuaccugaugangaaaucuucuu

SEQ ID NO: 4674 - DNA, 27 bp; single-stranded, linear
  The letter "N" represents the stem II region of an HH ribozyme.
ucccgguucugaugangaaacaaucuu

SEQ ID NO: 4675 - DNA, 27 bp; single-stranded, linear
  The letter "N" represents the stem II region of an HH ribozyme.
ucccaggacugaugangaaaggguuuc

SEQ ID NO: 4676 - DNA, 27 bp; single-stranded, linear
  The letter "N" represents the stem II region of an HH ribozyme.
gucccaggcugaugangaaaaggguuu

SEQ ID NO: 4677 - DNA, 27 bp; single-stranded, linear
  The letter "N" represents the stem II region of an HH ribozyme.
agucccagcugaugangaaaaaggguu

SEQ ID NO: 4678 - DNA, 27 bp; single-stranded, linear
  The letter "N" represents the stem II region of an HH ribozyme.
ugcucaaacugaugangaaacaucuuc

SEQ ID NO: 4679 - DNA, 27 bp; single-stranded, linear
  The letter "N" represents the stem II region of an HH ribozyme.
gugcucaacugaugangaaaacaucuu

SEQ ID NO: 4680 - DNA, 27 bp; single-stranded, linear
  The letter "N" represents the stem II region of an HH ribozyme.
ggugcucacugaugangaaaaacaucu

SEQ ID NO: 4681 - DNA, 27 bp; single-stranded, linear
  The letter "N" represents the stem II region of an HH ribozyme.
aggugcuccugaugangaaaaaacauc

SEQ ID NO: 4682 - DNA, 27 bp; single-stranded, linear
  The letter "N" represents the stem II region of an HH ribozyme.
cuauuguccugaugangaaaggugcuc

SEQ ID NO: 4683 - DNA, 27 bp; single-stranded, linear
  The letter "N" represents the stem II region of an HH ribozyme.
acacuuuccugaugangaaauugucaa

SEQ ID NO: 4684 - DNA, 27 bp; single-stranded, linear
  The letter "N" represents the stem II region of an HH ribozyme.
cacaggugcugaugangaaauuccccu

SEQ ID NO: 4685 - DNA, 27 bp; single-stranded, linear
  The letter "N" represents the stem II region of an HH ribozyme.
cuggacgccugaugangaaacacaggu

SEQ ID NO: 4686 - DNA, 27 bp; single-stranded, linear
  The letter "N" represents the stem II region of an HH ribozyme.
guccacugcugaugangaaacgcuaca

SEQ ID NO: 4687 - DNA, 27 bp; single-stranded, linear
  The letter "N" represents the stem II region of an HH ribozyme.
uuucucuucugaugangaaaucauccg

SEQ ID NO: 4688 - DNA, 27 bp; single-stranded, linear
  The letter "N" represents the stem II region of an HH ribozyme.
aaauguuccugaugangaaauuucucu

SEQ ID NO: 4689 - DNA, 27 bp; single-stranded, linear
  The letter "N" represents the stem II region of an HH ribozyme.
cucggacacugaugangaaauguucua

SEQ ID NO: 4690 - DNA, 27 bp; single-stranded, linear
  The letter "N" represents the stem II region of an HH ribozyme.
acucggaccugaugangaaaauguucu

SEQ ID NO: 4691 - DNA, 27 bp; single-stranded, linear
  The letter "N" represents the stem II region of an HH ribozyme.
ugaacucgcugaugangaaacaaaugu

SEQ ID NO: 4692 - DNA, 27 bp; single-stranded, linear
  The letter "N" represents the stem II region of an HH ribozyme.
uuugugugcugaugangaaacucggac

SEQ ID NO: 4693 - DNA, 27 bp; single-stranded, linear
  The letter "N" represents the stem II region of an HH ribozyme.
cuuugugucugaugangaaaacucgga

SEQ ID NO: 4694 - DNA, 27 bp; single-stranded, linear
  The letter "N" represents the stem II region of an HH ribozyme.
agcaauaacugaugangaaaggcuuug

SEQ ID NO: 4695 - DNA, 27 bp; single-stranded, linear
  The letter "N" represents the stem II region of an HH ribozyme.
aagcaauacugaugangaaaaggcuuu

SEQ ID NO: 4696 - DNA, 27 bp; single-stranded, linear
  The letter "N" represents the stem II region of an HH ribozyme.
aaagcaaucugaugangaaaaaggcuu

SEQ ID NO: 4697 - DNA, 27 bp; single-stranded, linear
  The letter "N" represents the stem II region of an HH ribozyme.
gaaagcaacugaugangaaaaaaggcu

SEQ ID NO: 4698 - DNA, 27 bp; single-stranded, linear
  The letter "N" represents the stem II region of an HH ribozyme.
ccgaaagccugaugangaaauaaaagg

SEQ ID NO: 4699 - DNA, 27 bp; single-stranded, linear
  The letter "N" represents the stem II region of an HH ribozyme.
acuaccgacugaugangaaagcaauaa

SEQ ID NO: 4700 - DNA, 27 bp; single-stranded, linear
  The letter "N" represents the stem II region of an HH ribozyme.
cacuaccgcugaugangaaaagcaaua

SEQ ID NO: 4701 - DNA, 27 bp; single-stranded, linear
  The letter "N" represents the stem II region of an HH ribozyme.
ccacuacccugaugangaaaaagcaau

SEQ ID NO: 4702 - DNA, 27 bp; single-stranded, linear
  The letter "N" represents the stem II region of an HH ribozyme.
caucccaccugaugangaaaccgaaag

SEQ ID NO: 4703 - DNA, 27 bp; single-stranded, linear
  The letter "N" represents the stem II region of an HH ribozyme.
ccaccaaacugaugangaaauuucauc

SEQ ID NO: 4704 - DNA, 27 bp; single-stranded, linear
  The letter "N" represents the stem II region of an HH ribozyme.
uuccaccacugaugangaaagauuuca

SEQ ID NO: 4705 - DNA, 27 bp; single-stranded, linear
  The letter "N" represents the stem II region of an HH ribozyme.
cuuccacccugaugangaaaagauuuc

SEQ ID NO: 4706 - DNA, 27 bp; single-stranded, linear
  The letter "N" represents the stem II region of an HH ribozyme.
ucggacuucugaugangaaacugccca

SEQ ID NO: 4707 - DNA, 27 bp; single-stranded, linear
  The letter "N" represents the stem II region of an HH ribozyme.
gggauucgcugaugangaaacuugacu

SEQ ID NO: 4708 - DNA, 27 bp; single-stranded, linear
  The letter "N" represents the stem II region of an HH ribozyme.
uucacaggcugaugangaaauucggac

SEQ ID NO: 4709 - DNA, 27 bp; single-stranded, linear
  The letter "N" represents the stem II region of an HH ribozyme.
aacugagacugaugangaaacuucaca

SEQ ID NO: 4710 - DNA, 27 bp; single-stranded, linear
  The letter "N" represents the stem II region of an HH ribozyme.
guaacugacugaugangaaauacuuca

SEQ ID NO: 4711 - DNA, 27 bp; single-stranded, linear
  The letter "N" represents the stem II region of an HH ribozyme.
ggguaacucugaugangaaagauacuu

SEQ ID NO: 4712 - DNA, 27 bp; single-stranded, linear
  The letter "N" represents the stem II region of an HH ribozyme.
agcugggucugaugangaaacugagau

SEQ ID NO: 4713 - DNA, 27 bp; single-stranded, linear
  The letter "N" represents the stem II region of an HH ribozyme.
gagcugggcugaugangaaaacugaga

SEQ ID NO: 4714 - DNA, 27 bp; single-stranded, linear
  The letter "N" represents the stem II region of an HH ribozyme.
gauaucagcugaugangaaagcugggu

SEQ ID NO: 4715 - DNA, 27 bp; single-stranded, linear
  The letter "N" represents the stem II region of an HH ribozyme.
ccauuugacugaugangaaaucaggag

SEQ ID NO: 4716 - DNA, 27 bp; single-stranded, linear
  The letter "N" represents the stem II region of an HH ribozyme.
uaccauuucugaugangaaauaucagg

SEQ ID NO: 4717 - DNA, 27 bp; single-stranded, linear
  The letter "N" represents the stem II region of an HH ribozyme.
cauuucugcugaugangaaaccauuug

SEQ ID NO: 4718 - DNA, 27 bp; single-stranded, linear
  The letter "N" represents the stem II region of an HH ribozyme.
uuggacuccugaugangaaaugggccu

SEQ ID NO: 4719 - DNA, 27 bp; single-stranded, linear
  The letter "N" represents the stem II region of an HH ribozyme.
uguaguugcugaugangaaacucaaug

SEQ ID NO: 4720 - DNA, 27 bp; single-stranded, linear
  The letter "N" represents the stem II region of an HH ribozyme.
ucauugugcugaugangaaaguuggac

SEQ ID NO: 4721 - DNA, 27 bp; single-stranded, linear
  The letter "N" represents the stem II region of an HH ribozyme.
ucgccaaccugaugangaaaucauugu

SEQ ID NO: 4722 - DNA, 27 bp; single-stranded, linear
  The letter "N" represents the stem II region of an HH ribozyme.
ucaucgcccugaugangaaacaaucau

SEQ ID NO: 4723 - DNA, 27 bp; single-stranded, linear
  The letter "N" represents the stem II region of an HH ribozyme.
augauggucugaugangaaaguucauc

SEQ ID NO: 4724 - DNA, 27 bp; single-stranded, linear
  The letter "N" represents the stem II region of an HH ribozyme.
acuuccaucugaugangaaauggugag

SEQ ID NO: 4725 - DNA, 27 bp; single-stranded, linear
  The letter "N" represents the stem II region of an HH ribozyme.
ugaccgugcugaugangaaaguuuccu

SEQ ID NO: 4726 - DNA, 27 bp; single-stranded, linear
  The letter "N" represents the stem II region of an HH ribozyme.
gugaggaucugaugangaaaccgugua

SEQ ID NO: 4727 - DNA, 27 bp; single-stranded, linear
  The letter "N" represents the stem II region of an HH ribozyme.
uuggugagcugaugangaaaugaccgu

SEQ ID NO: 4728 - DNA, 27 bp; single-stranded, linear
  The letter "N" represents the stem II region of an HH ribozyme.
ggguuggucugaugangaaaggaugac

SEQ ID NO: 4729 - DNA, 27 bp; single-stranded, linear
  The letter "N" represents the stem II region of an HH ribozyme.
uccauugacugaugangaaaugggguu

SEQ ID NO: 4730 - DNA, 27 bp; single-stranded, linear
  The letter "N" represents the stem II region of an HH ribozyme.
cuccauugcugaugangaaaauggggu

SEQ ID NO: 4731 - DNA, 27 bp; single-stranded, linear
  The letter "N" represents the stem II region of an HH ribozyme.
ucuccauucugaugangaaaaaugggg

SEQ ID NO: 4732 - DNA, 27 bp; single-stranded, linear
  The letter "N" represents the stem II region of an HH ribozyme.
accagagacugaugangaaaccaugug

SEQ ID NO: 4733 - DNA, 27 bp; single-stranded, linear
  The letter "N" represents the stem II region of an HH ribozyme.
caaccagacugaugangaaagaccaug

SEQ ID NO: 4734 - DNA, 27 bp; single-stranded, linear
  The letter "N" represents the stem II region of an HH ribozyme.
cacaaccacugaugangaaagagacca

SEQ ID NO: 4735 - DNA, 27 bp; single-stranded, linear
  The letter "N" represents the stem II region of an HH ribozyme.
acauucaccugaugangaaaccagaga

SEQ ID NO: 4736 - DNA, 27 bp; single-stranded, linear
  The letter "N" represents the stem II region of an HH ribozyme.
ugggguggcugaugangaaacauucac

SEQ ID NO: 4737 - DNA, 27 bp; single-stranded, linear
  The letter "N" represents the stem II region of an HH ribozyme.
uucucacccugaugangaaaucugggg

SEQ ID NO: 4738 - DNA, 27 bp; single-stranded, linear
  The letter "N" represents the stem II region of an HH ribozyme.
gcgagauccugaugangaaaggcuuuc

SEQ ID NO: 4739 - DNA, 27 bp; single-stranded, linear
  The letter "N" represents the stem II region of an HH ribozyme.
auaggcgacugaugangaaaucaaggc

SEQ ID NO: 4740 - DNA, 27 bp; single-stranded, linear
  The letter "N" represents the stem II region of an HH ribozyme.
ccauaggccugaugangaaagaucaag

SEQ ID NO: 4741 - DNA, 27 bp; single-stranded, linear
  The letter "N" represents the stem II region of an HH ribozyme.
ggaauccacugaugangaaaggcgaga

SEQ ID NO: 4742 - DNA, 27 bp; single-stranded, linear
  The letter "N" represents the stem II region of an HH ribozyme.
cugguaggcugaugangaaauccauag

SEQ ID NO: 4743 - DNA, 27 bp; single-stranded, linear
  The letter "N" represents the stem II region of an HH ribozyme.
acugguagcugaugangaaaauccaua

SEQ ID NO: 4744 - DNA, 27 bp; single-stranded, linear
  The letter "N" represents the stem II region of an HH ribozyme.
cauacuggcugaugangaaaggaaucc

SEQ ID NO: 4745 - DNA, 27 bp; single-stranded, linear
  The letter "N" represents the stem II region of an HH ribozyme.
uggucccacugaugangaaacugguag

SEQ ID NO: 4746 - DNA, 27 bp; single-stranded, linear
  The letter "N" represents the stem II region of an HH ribozyme.
ugcauguccugaugangaaaugucugc

SEQ ID NO: 4747 - DNA, 27 bp; single-stranded, linear
  The letter "N" represents the stem II region of an HH ribozyme.
uuggcguacugaugangaaacugugca

SEQ ID NO: 4748 - DNA, 27 bp; single-stranded, linear
  The letter "N" represents the stem II region of an HH ribozyme.
gguuggcgcugaugangaaagacugug

SEQ ID NO: 4749 - DNA, 27 bp; single-stranded, linear
  The letter "N" represents the stem II region of an HH ribozyme.
gugcagggcugaugangaaaggguugg

SEQ ID NO: 4750 - DNA, 27 bp; single-stranded, linear
  The letter "N" represents the stem II region of an HH ribozyme.
uaccacugcugaugangaaauguggug

SEQ ID NO: 4751 - DNA, 27 bp; single-stranded, linear
  The letter "N" represents the stem II region of an HH ribozyme.
gcugccagcugaugangaaaccacugg

SEQ ID NO: 4752 - DNA, 27 bp; single-stranded, linear
  The letter "N" represents the stem II region of an HH ribozyme.
gcuucuuccugaugangaaagcugcca

SEQ ID NO: 4753 - DNA, 27 bp; single-stranded, linear
  The letter "N" represents the stem II region of an HH ribozyme.
gucuguagcugaugangaaagcaggcu

SEQ ID NO: 4754 - DNA, 27 bp; single-stranded, linear
  The letter "N" represents the stem II region of an HH ribozyme.
cgggucugcugaugangaaaggagcag

SEQ ID NO: 4755 - DNA, 27 bp; single-stranded, linear
  The letter "N" represents the stem II region of an HH ribozyme.
uacaagcacugaugangaaacgggcuu

SEQ ID NO: 4756 - DNA, 27 bp; single-stranded, linear
  The letter "N" represents the stem II region of an HH ribozyme.
uucuuuaccugaugangaaagcauacg

SEQ ID NO: 4757 - DNA, 27 bp; single-stranded, linear
  The letter "N" represents the stem II region of an HH ribozyme.
ccauucuucugaugangaaacaagcau

SEQ ID NO: 4758 - DNA, 27 bp; single-stranded, linear
  The letter "N" represents the stem II region of an HH ribozyme.
ccccuggacugaugangaaauccucca

SEQ ID NO: 4759 - DNA, 27 bp; single-stranded, linear
  The letter "N" represents the stem II region of an HH ribozyme.
cccccuggcugaugangaaaauccucc

SEQ ID NO: 4760 - DNA, 27 bp; single-stranded, linear
  The letter "N" represents the stem II region of an HH ribozyme.
ccccccugcugaugangaaaaauccuc

SEQ ID NO: 4761 - DNA, 27 bp; single-stranded, linear
  The letter "N" represents the stem II region of an HH ribozyme.
gugacuuccugaugangaaaucuuguu

SEQ ID NO: 4762 - DNA, 27 bp; single-stranded, linear
  The letter "N" represents the stem II region of an HH ribozyme.
uuuuuggucugaugangaaacuucgau

SEQ ID NO: 4763 - DNA, 27 bp; single-stranded, linear
  The letter "N" represents the stem II region of an HH ribozyme.
ucagggcacugaugangaaauugguuu

SEQ ID NO: 4764 - DNA, 27 bp; single-stranded, linear
  The letter "N" represents the stem II region of an HH ribozyme.
uuuccuuccugaugangaaaucagggc

SEQ ID NO: 4765 - DNA, 27 bp; single-stranded, linear
  The letter "N" represents the stem II region of an HH ribozyme.
agcguacucugaugangaaacaguuuu

SEQ ID NO: 4766 - DNA, 27 bp; single-stranded, linear
  The letter "N" represents the stem II region of an HH ribozyme.
gaccagcgcugaugangaaacuuacag

SEQ ID NO: 4767 - DNA, 27 bp; single-stranded, linear
  The letter "N" represents the stem II region of an HH ribozyme.
gcuuggaucugaugangaaaccagcgu

SEQ ID NO: 4768 - DNA, 27 bp; single-stranded, linear
  The letter "N" represents the stem II region of an HH ribozyme.
gcagcuugcugaugangaaaugaccag

SEQ ID NO: 4769 - DNA, 27 bp; single-stranded, linear
  The letter "N" represents the stem II region of an HH ribozyme.
acaacgcucugaugangaaacacguug

SEQ ID NO: 4770 - DNA, 27 bp; single-stranded, linear
  The letter "N" represents the stem II region of an HH ribozyme.
auuuguaccugaugangaaacgcugac

SEQ ID NO: 4771 - DNA, 27 bp; single-stranded, linear
  The letter "N" represents the stem II region of an HH ribozyme.
cacauuugcugaugangaaacaacgcu

SEQ ID NO: 4772 - DNA, 27 bp; single-stranded, linear
  The letter "N" represents the stem II region of an HH ribozyme.
gcuuuguucugaugangaaauggcuuc

SEQ ID NO: 4773 - DNA, 27 bp; single-stranded, linear
  The letter "N" represents the stem II region of an HH ribozyme.
aaggagaucugaugangaaacccucuc

SEQ ID NO: 4774 - DNA, 27 bp; single-stranded, linear
  The letter "N" represents the stem II region of an HH ribozyme.
uggaaggacugaugangaaaugacccu

SEQ ID NO: 4775 - DNA, 27 bp; single-stranded, linear
  The letter "N" represents the stem II region of an HH ribozyme.
cauggaagcugaugangaaagaugacc

SEQ ID NO: 4776 - DNA, 27 bp; single-stranded, linear
  The letter "N" represents the stem II region of an HH ribozyme.
ucacauggcugaugangaaaggagaug

SEQ ID NO: 4777 - DNA, 27 bp; single-stranded, linear
  The letter "N" represents the stem II region of an HH ribozyme.
aucacaugcugaugangaaaaggagau

SEQ ID NO: 4778 - DNA, 27 bp; single-stranded, linear
  The letter "N" represents the stem II region of an HH ribozyme.
ggaccccucugaugangaaaucacaug

SEQ ID NO: 4779 - DNA, 27 bp; single-stranded, linear
  The letter "N" represents the stem II region of an HH ribozyme.
aauuucagcugaugangaaaccccuga

SEQ ID NO: 4780 - DNA, 27 bp; single-stranded, linear
  The letter "N" represents the stem II region of an HH ribozyme.
ugcacagucugaugangaaauuucagg

SEQ ID NO: 4781 - DNA, 27 bp; single-stranded, linear
  The letter "N" represents the stem II region of an HH ribozyme.
uugcacagcugaugangaaaauuucag

SEQ ID NO: 4782 - DNA, 27 bp; single-stranded, linear
  The letter "N" represents the stem II region of an HH ribozyme.
acaacaggcugaugangaaacacacuc

SEQ ID NO: 4783 - DNA, 27 bp; single-stranded, linear
  The letter "N" represents the stem II region of an HH ribozyme.
cagugcaccugaugangaaacagggac

SEQ ID NO: 4784 - DNA, 27 bp; single-stranded, linear
  The letter "N" represents the stem II region of an HH ribozyme.
cucaaacgcugaugangaaauuucugu

SEQ ID NO: 4785 - DNA, 27 bp; single-stranded, linear
  The letter "N" represents the stem II region of an HH ribozyme.
gguucucacugaugangaaacguauuu

SEQ ID NO: 4786 - DNA, 27 bp; single-stranded, linear
  The letter "N" represents the stem II region of an HH ribozyme.
agguucuccugaugangaaaacguauu

SEQ ID NO: 4787 - DNA, 27 bp; single-stranded, linear
  The letter "N" represents the stem II region of an HH ribozyme.
uaccacgucugaugangaaagguucuc

SEQ ID NO: 4788 - DNA, 27 bp; single-stranded, linear
  The letter "N" represents the stem II region of an HH ribozyme.
caagcuugcugaugangaaaccacgug

SEQ ID NO: 4789 - DNA, 27 bp; single-stranded, linear
  The letter "N" represents the stem II region of an HH ribozyme.
ugugagcccugaugangaaagcuugua

SEQ ID NO: 4790 - DNA, 27 bp; single-stranded, linear
  The letter "N" represents the stem II region of an HH ribozyme.
uugccugucugaugangaaagccaagc

SEQ ID NO: 4791 - DNA, 27 bp; single-stranded, linear
  The letter "N" represents the stem II region of an HH ribozyme.
uguggacccugaugangaaauguugcc

SEQ ID NO: 4792 - DNA, 27 bp; single-stranded, linear
  The letter "N" represents the stem II region of an HH ribozyme.
cccaugugcugaugangaaaccgaugu

SEQ ID NO: 4793 - DNA, 27 bp; single-stranded, linear
  The letter "N" represents the stem II region of an HH ribozyme.
gugugagucugaugangaaauucgccc

SEQ ID NO: 4794 - DNA, 27 bp; single-stranded, linear
  The letter "N" represents the stem II region of an HH ribozyme.
acuggugucugaugangaaagugauuc

SEQ ID NO: 4795 - DNA, 27 bp; single-stranded, linear
  The letter "N" represents the stem II region of an HH ribozyme.
uucuugcacugaugangaaacuggugu

SEQ ID NO: 4796 - DNA, 27 bp; single-stranded, linear
  The letter "N" represents the stem II region of an HH ribozyme.
guucuugccugaugangaaaacuggug

SEQ ID NO: 4797 - DNA, 27 bp; single-stranded, linear
  The letter "N" represents the stem II region of an HH ribozyme.
gagcaucccugaugangaaaguucuug

SEQ ID NO: 4798 - DNA, 27 bp; single-stranded, linear
  The letter "N" represents the stem II region of an HH ribozyme.
uuuccaaacugaugangaaagcaucca

SEQ ID NO: 4799 - DNA, 27 bp; single-stranded, linear
  The letter "N" represents the stem II region of an HH ribozyme.
aguuuccacugaugangaaagagcauc

SEQ ID NO: 4800 - DNA, 27 bp; single-stranded, linear
  The letter "N" represents the stem II region of an HH ribozyme.
caguuucccugaugangaaaagagcau

SEQ ID NO: 4801 - DNA, 27 bp; single-stranded, linear
  The letter "N" represents the stem II region of an HH ribozyme.
uguuagaacugaugangaaacauggug

SEQ ID NO: 4802 - DNA, 27 bp; single-stranded, linear
  The letter "N" represents the stem II region of an HH ribozyme.
cuguuagacugaugangaaaacauggu

SEQ ID NO: 4803 - DNA, 27 bp; single-stranded, linear
  The letter "N" represents the stem II region of an HH ribozyme.
gcuguuagcugaugangaaaaacaugg

SEQ ID NO: 4804 - DNA, 27 bp; single-stranded, linear
  The letter "N" represents the stem II region of an HH ribozyme.
ugcuguuacugaugangaaaaaacaug

SEQ ID NO: 4805 - DNA, 27 bp; single-stranded, linear
  The letter "N" represents the stem II region of an HH ribozyme.
ugugcugucugaugangaaagaaaaca

SEQ ID NO: 4806 - DNA, 27 bp; single-stranded, linear
  The letter "N" represents the stem II region of an HH ribozyme.
acaaucaacugaugangaaaugucauu

SEQ ID NO: 4807 - DNA, 27 bp; single-stranded, linear
  The letter "N" represents the stem II region of an HH ribozyme.
ccacaauccugaugangaaagauguca

SEQ ID NO: 4808 - DNA, 27 bp; single-stranded, linear
  The letter "N" represents the stem II region of an HH ribozyme.
aaugccaccugaugangaaaucaagau

SEQ ID NO: 4809 - DNA, 27 bp; single-stranded, linear
  The letter "N" represents the stem II region of an HH ribozyme.
cauucugacugaugangaaaugccaca

SEQ ID NO: 4810 - DNA, 27 bp; single-stranded, linear
  The letter "N" represents the stem II region of an HH ribozyme.
gcauucugcugaugangaaaaugccac

SEQ ID NO: 4811 - DNA, 27 bp; single-stranded, linear
  The letter "N" represents the stem II region of an HH ribozyme.
ggcauucucugaugangaaaaaugcca

SEQ ID NO: 4812 - DNA, 27 bp; single-stranded, linear
  The letter "N" represents the stem II region of an HH ribozyme.
ccugcagacugaugangaaaggcauuc

SEQ ID NO: 4813 - DNA, 27 bp; single-stranded, linear
  The letter "N" represents the stem II region of an HH ribozyme.
guccugcacugaugangaaagaggcau

SEQ ID NO: 4814 - DNA, 27 bp; single-stranded, linear
  The letter "N" represents the stem II region of an HH ribozyme.
agcaaacacugaugangaaagucgccu

SEQ ID NO: 4815 - DNA, 27 bp; single-stranded, linear
  The letter "N" represents the stem II region of an HH ribozyme.
gcagagcacugaugangaaacauaguc

SEQ ID NO: 4816 - DNA, 27 bp; single-stranded, linear
  The letter "N" represents the stem II region of an HH ribozyme.
agcagagccugaugangaaaacauagu

SEQ ID NO: 4817 - DNA, 27 bp; single-stranded, linear
  The letter "N" represents the stem II region of an HH ribozyme.
cuugagcacugaugangaaagcaaaca

SEQ ID NO: 4818 - DNA, 27 bp; single-stranded, linear
  The letter "N" represents the stem II region of an HH ribozyme.
cuuaucuucugaugangaaagcagagc

SEQ ID NO: 4819 - DNA, 27 bp; single-stranded, linear
  The letter "N" represents the stem II region of an HH ribozyme.
ggucuucucugaugangaaaucuugag

SEQ ID NO: 4820 - DNA, 27 bp; single-stranded, linear
  The letter "N" represents the stem II region of an HH ribozyme.
gaccaggccugaugangaaaugucuuu

SEQ ID NO: 4821 - DNA, 27 bp; single-stranded, linear
  The letter "N" represents the stem II region of an HH ribozyme.
agcuguuucugaugangaaaccaggca

SEQ ID NO: 4822 - DNA, 27 bp; single-stranded, linear
  The letter "N" represents the stem II region of an HH ribozyme.
aggaugaucugaugangaaagcuguuu

SEQ ID NO: 4823 - DNA, 27 bp; single-stranded, linear
  The letter "N" represents the stem II region of an HH ribozyme.
ucuaggaucugaugangaaaugagcug

SEQ ID NO: 4824 - DNA, 27 bp; single-stranded, linear
  The letter "N" represents the stem II region of an HH ribozyme.
cgcucuagcugaugangaaaugaugag

SEQ ID NO: 4825 - DNA, 27 bp; single-stranded, linear
  The letter "N" represents the stem II region of an HH ribozyme.
augcgcuccugaugangaaaggaugau

SEQ ID NO: 4826 - DNA, 27 bp; single-stranded, linear
  The letter "N" represents the stem II region of an HH ribozyme.
uuuccggucugaugangaaaucauggg

SEQ ID NO: 4827 - DNA, 27 bp; single-stranded, linear
  The letter "N" represents the stem II region of an HH ribozyme.
auucuccacugaugangaaauuuccgg

SEQ ID NO: 4828 - DNA, 27 bp; single-stranded, linear
  The letter "N" represents the stem II region of an HH ribozyme.
uguugucucugaugangaaauucucca

SEQ ID NO: 4829 - DNA, 27 bp; single-stranded, linear
  The letter "N" represents the stem II region of an HH ribozyme.
gucucgcccugaugangaaaugguugu

SEQ ID NO: 4830 - DNA, 27 bp; single-stranded, linear
  The letter "N" represents the stem II region of an HH ribozyme.
gucacuuccugaugangaaauggucuc

SEQ ID NO: 4831 - DNA, 27 bp; single-stranded, linear
  The letter "N" represents the stem II region of an HH ribozyme.
ugcugggccugaugangaaagucacuu

SEQ ID NO: 4832 - DNA, 27 bp; single-stranded, linear
  The letter "N" represents the stem II region of an HH ribozyme.
gauuuccacugaugangaaaugcuggg

SEQ ID NO: 4833 - DNA, 27 bp; single-stranded, linear
  The letter "N" represents the stem II region of an HH ribozyme.
ugggguagcugaugangaaauuuccag

SEQ ID NO: 4834 - DNA, 27 bp; single-stranded, linear
  The letter "N" represents the stem II region of an HH ribozyme.
guguggggcugaugangaaaggauuuc

SEQ ID NO: 4835 - DNA, 27 bp; single-stranded, linear
  The letter "N" represents the stem II region of an HH ribozyme.
aaccaugucugaugangaaaugugugg

SEQ ID NO: 4836 - DNA, 27 bp; single-stranded, linear
  The letter "N" represents the stem II region of an HH ribozyme.
gaaccaugcugaugangaaaaugugug

SEQ ID NO: 4837 - DNA, 27 bp; single-stranded, linear
  The letter "N" represents the stem II region of an HH ribozyme.
ugucuuugcugaugangaaaccaugua

SEQ ID NO: 4838 - DNA, 27 bp; single-stranded, linear
  The letter "N" represents the stem II region of an HH ribozyme.
uugucuuucugaugangaaaaccaugu

SEQ ID NO: 4839 - DNA, 27 bp; single-stranded, linear
  The letter "N" represents the stem II region of an HH ribozyme.
gaaucuuccugaugangaaaccagggu

SEQ ID NO: 4840 - DNA, 27 bp; single-stranded, linear
  The letter "N" represents the stem II region of an HH ribozyme.
aaugccugcugaugangaaaucuucua

SEQ ID NO: 4841 - DNA, 27 bp; single-stranded, linear
  The letter "N" represents the stem II region of an HH ribozyme.
caaugccucugaugangaaaaucuucu

SEQ ID NO: 4842 - DNA, 27 bp; single-stranded, linear
  The letter "N" represents the stem II region of an HH ribozyme.
cucaguaccugaugangaaaugccuga

SEQ ID NO: 4843 - DNA, 27 bp; single-stranded, linear
  The letter "N" represents the stem II region of an HH ribozyme.
ucucucagcugaugangaaacaaugcc

SEQ ID NO: 4844 - DNA, 27 bp; single-stranded, linear
  The letter "N" represents the stem II region of an HH ribozyme.
ccugcggacugaugangaaagucaggu

SEQ ID NO: 4845 - DNA, 27 bp; single-stranded, linear
  The letter "N" represents the stem II region of an HH ribozyme.
acccugcgcugaugangaaauagucag

SEQ ID NO: 4846 - DNA, 27 bp; single-stranded, linear
  The letter "N" represents the stem II region of an HH ribozyme.
cagguguacugaugangaaaggccucc

SEQ ID NO: 4847 - DNA, 27 bp; single-stranded, linear
  The letter "N" represents the stem II region of an HH ribozyme.
ggcaggugcugaugangaaagaggccu

SEQ ID NO: 4848 - DNA, 27 bp; single-stranded, linear
  The letter "N" represents the stem II region of an HH ribozyme.
cagccaagcugaugangaaacauugca

SEQ ID NO: 4849 - DNA, 27 bp; single-stranded, linear
  The letter "N" represents the stem II region of an HH ribozyme.
gcacagcccugaugangaaaggacauu

SEQ ID NO: 4850 - DNA, 27 bp; single-stranded, linear
  The letter "N" represents the stem II region of an HH ribozyme.
auuaugaacugaugangaaagcgucuc

SEQ ID NO: 4851 - DNA, 27 bp; single-stranded, linear
  The letter "N" represents the stem II region of an HH ribozyme.
cuauuaugcugaugangaaagagcguc

SEQ ID NO: 4852 - DNA, 27 bp; single-stranded, linear
  The letter "N" represents the stem II region of an HH ribozyme.
ucuauuaucugaugangaaaagagcgu

SEQ ID NO: 4853 - DNA, 27 bp; single-stranded, linear
  The letter "N" represents the stem II region of an HH ribozyme.
ccuucuaucugaugangaaaugaagag

SEQ ID NO: 4854 - DNA, 27 bp; single-stranded, linear
  The letter "N" represents the stem II region of an HH ribozyme.
gcaccuuccugaugangaaauuaugaa

SEQ ID NO: 4855 - DNA, 27 bp; single-stranded, linear
  The letter "N" represents the stem II region of an HH ribozyme.
ugacuucccugaugangaaaguugguc

SEQ ID NO: 4856 - DNA, 27 bp; single-stranded, linear
  The letter "N" represents the stem II region of an HH ribozyme.
aggauaaucugaugangaaacuuccaa

SEQ ID NO: 4857 - DNA, 27 bp; single-stranded, linear
  The letter "N" represents the stem II region of an HH ribozyme.
acgaggaucugaugangaaaugacuuc

SEQ ID NO: 4858 - DNA, 27 bp; single-stranded, linear
  The letter "N" represents the stem II region of an HH ribozyme.
gacgaggacugaugangaaaaugacuu

SEQ ID NO: 4859 - DNA, 27 bp; single-stranded, linear
  The letter "N" represents the stem II region of an HH ribozyme.
ccgacgagcugaugangaaauaaugac

SEQ ID NO: 4860 - DNA, 27 bp; single-stranded, linear
  The letter "N" represents the stem II region of an HH ribozyme.
gugccgaccugaugangaaaggauaau

SEQ ID NO: 4861 - DNA, 27 bp; single-stranded, linear
  The letter "N" represents the stem II region of an HH ribozyme.
gcagugcccugaugangaaacgaggau

SEQ ID NO: 4862 - DNA, 27 bp; single-stranded, linear
  The letter "N" represents the stem II region of an HH ribozyme.
aacauggccugaugangaaaucacugc

SEQ ID NO: 4863 - DNA, 27 bp; single-stranded, linear
  The letter "N" represents the stem II region of an HH ribozyme.
gccagaagcugaugangaaacauggca

SEQ ID NO: 4864 - DNA, 27 bp; single-stranded, linear
  The letter "N" represents the stem II region of an HH ribozyme.
agccagaacugaugangaaaacauggc

SEQ ID NO: 4865 - DNA, 27 bp; single-stranded, linear
  The letter "N" represents the stem II region of an HH ribozyme.
ggagccagcugaugangaaagaacaug

SEQ ID NO: 4866 - DNA, 27 bp; single-stranded, linear
  The letter "N" represents the stem II region of an HH ribozyme.
aggagccacugaugangaaaagaacau

SEQ ID NO: 4867 - DNA, 27 bp; single-stranded, linear
  The letter "N" represents the stem II region of an HH ribozyme.
acaagaagcugaugangaaagccagaa

SEQ ID NO: 4868 - DNA, 27 bp; single-stranded, linear
  The letter "N" represents the stem II region of an HH ribozyme.
augacaagcugaugangaaaggagcca

SEQ ID NO: 4869 - DNA, 27 bp; single-stranded, linear
  The letter "N" represents the stem II region of an HH ribozyme.
aaugacaacugaugangaaaaggagcc

SEQ ID NO: 4870 - DNA, 27 bp; single-stranded, linear
  The letter "N" represents the stem II region of an HH ribozyme.
acaaugaccugaugangaaagaaggag

SEQ ID NO: 4871 - DNA, 27 bp; single-stranded, linear
  The letter "N" represents the stem II region of an HH ribozyme.
aggacaaucugaugangaaacaagaag

SEQ ID NO: 4872 - DNA, 27 bp; single-stranded, linear
  The letter "N" represents the stem II region of an HH ribozyme.
cguaggaccugaugangaaaugacaag

SEQ ID NO: 4873 - DNA, 27 bp; single-stranded, linear
  The letter "N" represents the stem II region of an HH ribozyme.
guccguagcugaugangaaacaaugac

SEQ ID NO: 4874 - DNA, 27 bp; single-stranded, linear
  The letter "N" represents the stem II region of an HH ribozyme.
acgguccgcugaugangaaaggacaau

SEQ ID NO: 4875 - DNA, 27 bp; single-stranded, linear
  The letter "N" represents the stem II region of an HH ribozyme.
gcccgcuucugaugangaaacgguccg

SEQ ID NO: 4876 - DNA, 27 bp; single-stranded, linear
  The letter "N" represents the stem II region of an HH ribozyme.
ggcccgcucugaugangaaaacggucc

SEQ ID NO: 4877 - DNA, 27 bp; single-stranded, linear
  The letter "N" represents the stem II region of an HH ribozyme.
uagacaagcugaugangaaagccuguc

SEQ ID NO: 4878 - DNA, 27 bp; single-stranded, linear
  The letter "N" represents the stem II region of an HH ribozyme.
caauagaccugaugangaaaguagccu

SEQ ID NO: 4879 - DNA, 27 bp; single-stranded, linear
  The letter "N" represents the stem II region of an HH ribozyme.
ugacaauacugaugangaaacaaguag

SEQ ID NO: 4880 - DNA, 27 bp; single-stranded, linear
  The letter "N" represents the stem II region of an HH ribozyme.
caugacaacugaugangaaagacaagu

SEQ ID NO: 4881 - DNA, 27 bp; single-stranded, linear
  The letter "N" represents the stem II region of an HH ribozyme.
uccaugaccugaugangaaauagacaa

SEQ ID NO: 4882 - DNA, 27 bp; single-stranded, linear
  The letter "N" represents the stem II region of an HH ribozyme.
ggauccaucugaugangaaacaauaga

SEQ ID NO: 4883 - DNA, 27 bp; single-stranded, linear
  The letter "N" represents the stem II region of an HH ribozyme.
uucaucugcugaugangaaauccauga

SEQ ID NO: 4884 - DNA, 27 bp; single-stranded, linear
  The letter "N" represents the stem II region of an HH ribozyme.
ccaagggccugaugangaaauucaucu

SEQ ID NO: 4885 - DNA, 27 bp; single-stranded, linear
  The letter "N" represents the stem II region of an HH ribozyme.
gcucaucccugaugangaaagggcaau

SEQ ID NO: 4886 - DNA, 27 bp; single-stranded, linear
  The letter "N" represents the stem II region of an HH ribozyme.
cauaaggccugaugangaaagcguuca

SEQ ID NO: 4887 - DNA, 27 bp; single-stranded, linear
  The letter "N" represents the stem II region of an HH ribozyme.
ggcaucaucugaugangaaaggcaagc

SEQ ID NO: 4888 - DNA, 27 bp; single-stranded, linear
  The letter "N" represents the stem II region of an HH ribozyme.
uggcaucacugaugangaaaaggcaag

SEQ ID NO: 4889 - DNA, 27 bp; single-stranded, linear
  The letter "N" represents the stem II region of an HH ribozyme.
cccuggggcugaugangaaauucccac

SEQ ID NO: 4890 - DNA, 27 bp; single-stranded, linear
  The letter "N" represents the stem II region of an HH ribozyme.
ucccugggcugaugangaaaauuccca

SEQ ID NO: 4891 - DNA, 27 bp; single-stranded, linear
  The letter "N" represents the stem II region of an HH ribozyme.
gguuuucccugaugangaaaguuucag

SEQ ID NO: 4892 - DNA, 27 bp; single-stranded, linear
  The letter "N" represents the stem II region of an HH ribozyme.
gcggccaacugaugangaaagguuuuc

SEQ ID NO: 4893 - DNA, 27 bp; single-stranded, linear
  The letter "N" represents the stem II region of an HH ribozyme.
ccgcggcccugaugangaaagagguuu

SEQ ID NO: 4894 - DNA, 27 bp; single-stranded, linear
  The letter "N" represents the stem II region of an HH ribozyme.
cuuggccgcugaugangaaaggcaccg

SEQ ID NO: 4895 - DNA, 27 bp; single-stranded, linear
  The letter "N" represents the stem II region of an HH ribozyme.
acuuggcccugaugangaaaaggcacc

SEQ ID NO: 4896 - DNA, 27 bp; single-stranded, linear
  The letter "N" represents the stem II region of an HH ribozyme.
ucugccuccugaugangaaaucacuug

SEQ ID NO: 4897 - DNA, 27 bp; single-stranded, linear
  The letter "N" represents the stem II region of an HH ribozyme.
aauuccaacugaugangaaagcgucug

SEQ ID NO: 4898 - DNA, 27 bp; single-stranded, linear
  The letter "N" represents the stem II region of an HH ribozyme.
caauuccacugaugangaaaagcgucu

SEQ ID NO: 4899 - DNA, 27 bp; single-stranded, linear
  The letter "N" represents the stem II region of an HH ribozyme.
ucaauucccugaugangaaaaagcguc

SEQ ID NO: 4900 - DNA, 27 bp; single-stranded, linear
  The letter "N" represents the stem II region of an HH ribozyme.
gucuuguccugaugangaaauuccaaa

SEQ ID NO: 4901 - DNA, 27 bp; single-stranded, linear
  The letter "N" represents the stem II region of an HH ribozyme.
uguuuugccugaugangaaagucgcug

SEQ ID NO: 4902 - DNA, 27 bp; single-stranded, linear
  The letter "N" represents the stem II region of an HH ribozyme.
uugacggccugaugangaaacuguuuu

SEQ ID NO: 4903 - DNA, 27 bp; single-stranded, linear
  The letter "N" represents the stem II region of an HH ribozyme.
aacaucuucugaugangaaacggcuac

SEQ ID NO: 4904 - DNA, 27 bp; single-stranded, linear
  The letter "N" represents the stem II region of an HH ribozyme.
cuucuuuccugaugangaaacaucuug

SEQ ID NO: 4905 - DNA, 27 bp; single-stranded, linear
  The letter "N" represents the stem II region of an HH ribozyme.
gagggcuccugaugangaaaugcucgc

SEQ ID NO: 4906 - DNA, 27 bp; single-stranded, linear
  The letter "N" represents the stem II region of an HH ribozyme.
ucagacaucugaugangaaagggcucg

SEQ ID NO: 4907 - DNA, 27 bp; single-stranded, linear
  The letter "N" represents the stem II region of an HH ribozyme.
ugaguucacugaugangaaacaugagg

SEQ ID NO: 4908 - DNA, 27 bp; single-stranded, linear
  The letter "N" represents the stem II region of an HH ribozyme.
aggaucuucugaugangaaaguucaga

SEQ ID NO: 4909 - DNA, 27 bp; single-stranded, linear
  The letter "N" represents the stem II region of an HH ribozyme.
uggaugagcugaugangaaaucuugag

SEQ ID NO: 4910 - DNA, 27 bp; single-stranded, linear
  The letter "N" represents the stem II region of an HH ribozyme.
auguggaucugaugangaaaggaucuu

SEQ ID NO: 4911 - DNA, 27 bp; single-stranded, linear
  The letter "N" represents the stem II region of an HH ribozyme.
ccaaugugcugaugangaaaugaggau

SEQ ID NO: 4912 - DNA, 27 bp; single-stranded, linear
  The letter "N" represents the stem II region of an HH ribozyme.
uggugacccugaugangaaauguggau

SEQ ID NO: 4913 - DNA, 27 bp; single-stranded, linear
  The letter "N" represents the stem II region of an HH ribozyme.
gagauggucugaugangaaaccaaugu

SEQ ID NO: 4914 - DNA, 27 bp; single-stranded, linear
  The letter "N" represents the stem II region of an HH ribozyme.
cacauugacugaugangaaauggugac

SEQ ID NO: 4915 - DNA, 27 bp; single-stranded, linear
  The letter "N" represents the stem II region of an HH ribozyme.
accacauucugaugangaaagauggug

SEQ ID NO: 4916 - DNA, 27 bp; single-stranded, linear
  The letter "N" represents the stem II region of an HH ribozyme.
gcgccuagcugaugangaaagguucac

SEQ ID NO: 4917 - DNA, 27 bp; single-stranded, linear
  The letter "N" represents the stem II region of an HH ribozyme.
caggcgcccugaugangaaaggagguu

SEQ ID NO: 4918 - DNA, 27 bp; single-stranded, linear
  The letter "N" represents the stem II region of an HH ribozyme.
caccaugacugaugangaaaggcccuc

SEQ ID NO: 4919 - DNA, 27 bp; single-stranded, linear
  The letter "N" represents the stem II region of an HH ribozyme.
aucaccaucugaugangaaagaggccc

SEQ ID NO: 4920 - DNA, 27 bp; single-stranded, linear
  The letter "N" represents the stem II region of an HH ribozyme.
aauuccaccugaugangaaaucaccau

SEQ ID NO: 4921 - DNA, 27 bp; single-stranded, linear
  The letter "N" represents the stem II region of an HH ribozyme.
acuugcagcugaugangaaauuccaca

SEQ ID NO: 4922 - DNA, 27 bp; single-stranded, linear
  The letter "N" represents the stem II region of an HH ribozyme.
aacuugcacugaugangaaaauuccac

SEQ ID NO: 4923 - DNA, 27 bp; single-stranded, linear
  The letter "N" represents the stem II region of an HH ribozyme.
gguuuccacugaugangaaacuugcag

SEQ ID NO: 4924 - DNA, 27 bp; single-stranded, linear
  The letter "N" represents the stem II region of an HH ribozyme.
agguuucccugaugangaaaacuugca

SEQ ID NO: 4925 - DNA, 27 bp; single-stranded, linear
  The letter "N" represents the stem II region of an HH ribozyme.
uaaguugacugaugangaaagguuucc

SEQ ID NO: 4926 - DNA, 27 bp; single-stranded, linear
  The letter "N" represents the stem II region of an HH ribozyme.
aguaaguucugaugangaaauagguuu

SEQ ID NO: 4927 - DNA, 27 bp; single-stranded, linear
  The letter "N" represents the stem II region of an HH ribozyme.
ccguaagucugaugangaaaguugaua

SEQ ID NO: 4928 - DNA, 27 bp; single-stranded, linear
  The letter "N" represents the stem II region of an HH ribozyme.
cccguaagcugaugangaaaaguugau

SEQ ID NO: 4929 - DNA, 27 bp; single-stranded, linear
  The letter "N" represents the stem II region of an HH ribozyme.
ugccccgucugaugangaaaguaaguu

SEQ ID NO: 4930 - DNA, 27 bp; single-stranded, linear
  The letter "N" represents the stem II region of an HH ribozyme.
uugccccgcugaugangaaaaguaagu

SEQ ID NO: 4931 - DNA, 27 bp; single-stranded, linear
  The letter "N" represents the stem II region of an HH ribozyme.
agggaacacugaugangaaauucauuu

SEQ ID NO: 4932 - DNA, 27 bp; single-stranded, linear
  The letter "N" represents the stem II region of an HH ribozyme.
uagggaaccugaugangaaaauucauu

SEQ ID NO: 4933 - DNA, 27 bp; single-stranded, linear
  The letter "N" represents the stem II region of an HH ribozyme.
uuauagggcugaugangaaacaaauuc

SEQ ID NO: 4934 - DNA, 27 bp; single-stranded, linear
  The letter "N" represents the stem II region of an HH ribozyme.
cuuauaggcugaugangaaaacaaauu

SEQ ID NO: 4935 - DNA, 27 bp; single-stranded, linear
  The letter "N" represents the stem II region of an HH ribozyme.
ugcucuuacugaugangaaagggaaca

SEQ ID NO: 4936 - DNA, 27 bp; single-stranded, linear
  The letter "N" represents the stem II region of an HH ribozyme.
uuugcucucugaugangaaauagggaa

SEQ ID NO: 4937 - DNA, 27 bp; single-stranded, linear
  The letter "N" represents the stem II region of an HH ribozyme.
ccuggcggcugaugangaaagcgugcc

SEQ ID NO: 4938 - DNA, 27 bp; single-stranded, linear
  The letter "N" represents the stem II region of an HH ribozyme.
cccuggcgcugaugangaaaagcgugc

SEQ ID NO: 4939 - DNA, 27 bp; single-stranded, linear
  The letter "N" represents the stem II region of an HH ribozyme.
ccccaacgcugaugangaaaguccuug

SEQ ID NO: 4940 - DNA, 27 bp; single-stranded, linear
  The letter "N" represents the stem II region of an HH ribozyme.
agcucccccugaugangaaacguaguc

SEQ ID NO: 4941 - DNA, 27 bp; single-stranded, linear
  The letter "N" represents the stem II region of an HH ribozyme.
uccacggacugaugangaaagcucccc

SEQ ID NO: 4942 - DNA, 27 bp; single-stranded, linear
  The letter "N" represents the stem II region of an HH ribozyme.
gauccacgcugaugangaaagagcucc

SEQ ID NO: 4943 - DNA, 27 bp; single-stranded, linear
  The letter "N" represents the stem II region of an HH ribozyme.
ucuuuucacugaugangaaauccacgg

SEQ ID NO: 4944 - DNA, 27 bp; single-stranded, linear
  The letter "N" represents the stem II region of an HH ribozyme.
ugcugucccugaugangaaagcgucuu

SEQ ID NO: 4945 - DNA, 27 bp; single-stranded, linear
  The letter "N" represents the stem II region of an HH ribozyme.
cugcuggucugaugangaaaugcuguc

SEQ ID NO: 4946 - DNA, 27 bp; single-stranded, linear
  The letter "N" represents the stem II region of an HH ribozyme.
agcuggcacugaugangaaagcucugg

SEQ ID NO: 4947 - DNA, 27 bp; single-stranded, linear
  The letter "N" represents the stem II region of an HH ribozyme.
caaagccucugaugangaaagcuggca

SEQ ID NO: 4948 - DNA, 27 bp; single-stranded, linear
  The letter "N" represents the stem II region of an HH ribozyme.
ccucaacacugaugangaaagccugag

SEQ ID NO: 4949 - DNA, 27 bp; single-stranded, linear
  The letter "N" represents the stem II region of an HH ribozyme.
uccucaaccugaugangaaaagccuga

SEQ ID NO: 4950 - DNA, 27 bp; single-stranded, linear
  The letter "N" represents the stem II region of an HH ribozyme.
uucuccuccugaugangaaacaaagcc

SEQ ID NO: 4951 - DNA, 27 bp; single-stranded, linear
  The letter "N" represents the stem II region of an HH ribozyme.
cacugagccugaugangaaauuucucc

SEQ ID NO: 4952 - DNA, 27 bp; single-stranded, linear
  The letter "N" represents the stem II region of an HH ribozyme.
acaucacucugaugangaaagcgauuu

SEQ ID NO: 4953 - DNA, 27 bp; single-stranded, linear
  The letter "N" represents the stem II region of an HH ribozyme.
ucuuccuccugaugangaaacaucacu

SEQ ID NO: 4954 - DNA, 27 bp; single-stranded, linear
  The letter "N" represents the stem II region of an HH ribozyme.
uucuucagcugaugangaaagcuucuu

SEQ ID NO: 4955 - DNA, 27 bp; single-stranded, linear
  The letter "N" represents the stem II region of an HH ribozyme.
guucuucacugaugangaaaagcuucu

SEQ ID NO: 4956 - DNA, 27 bp; single-stranded, linear
  The letter "N" represents the stem II region of an HH ribozyme.
aguccuugcugaugangaaacaguucu

SEQ ID NO: 4957 - DNA, 27 bp; single-stranded, linear
  The letter "N" represents the stem II region of an HH ribozyme.
aggucaggcugaugangaaaguccuug

SEQ ID NO: 4958 - DNA, 27 bp; single-stranded, linear
  The letter "N" represents the stem II region of an HH ribozyme.
aaggucagcugaugangaaaaguccuu

SEQ ID NO: 4959 - DNA, 27 bp; single-stranded, linear
  The letter "N" represents the stem II region of an HH ribozyme.
gaugcucccugaugangaaaggucagg

SEQ ID NO: 4960 - DNA, 27 bp; single-stranded, linear
  The letter "N" represents the stem II region of an HH ribozyme.
acagaugacugaugangaaaugcucca

SEQ ID NO: 4961 - DNA, 27 bp; single-stranded, linear
  The letter "N" represents the stem II region of an HH ribozyme.
uaacagaucugaugangaaagaugcuc

SEQ ID NO: 4962 - DNA, 27 bp; single-stranded, linear
  The letter "N" represents the stem II region of an HH ribozyme.
cuguaacacugaugangaaaugagaug

SEQ ID NO: 4963 - DNA, 27 bp; single-stranded, linear
  The letter "N" represents the stem II region of an HH ribozyme.
gaagcugucugaugangaaacagauga

SEQ ID NO: 4964 - DNA, 27 bp; single-stranded, linear
  The letter "N" represents the stem II region of an HH ribozyme.
ggaagcugcugaugangaaaacagaug

SEQ ID NO: 4965 - DNA, 27 bp; single-stranded, linear
  The letter "N" represents the stem II region of an HH ribozyme.
ccacuuggcugaugangaaagcuguaa

SEQ ID NO: 4966 - DNA, 27 bp; single-stranded, linear
  The letter "N" represents the stem II region of an HH ribozyme.
gccacuugcugaugangaaaagcugua

SEQ ID NO: 4967 - DNA, 27 bp; single-stranded, linear
  The letter "N" represents the stem II region of an HH ribozyme.
caugcccucugaugangaaagccacuu

SEQ ID NO: 4968 - DNA, 27 bp; single-stranded, linear
  The letter "N" represents the stem II region of an HH ribozyme.
augccaagcugaugangaaacuccaug

SEQ ID NO: 4969 - DNA, 27 bp; single-stranded, linear
  The letter "N" represents the stem II region of an HH ribozyme.
gaugccaacugaugangaaaacuccau

SEQ ID NO: 4970 - DNA, 27 bp; single-stranded, linear
  The letter "N" represents the stem II region of an HH ribozyme.
uugaugcccugaugangaaagaacucc

SEQ ID NO: 4971 - DNA, 27 bp; single-stranded, linear
  The letter "N" represents the stem II region of an HH ribozyme.
acuuccuucugaugangaaaugccaag

SEQ ID NO: 4972 - DNA, 27 bp; single-stranded, linear
  The letter "N" represents the stem II region of an HH ribozyme.
ccuguggacugaugangaaacacuucc

SEQ ID NO: 4973 - DNA, 27 bp; single-stranded, linear
  The letter "N" represents the stem II region of an HH ribozyme.
ucccugugcugaugangaaauacacuu

SEQ ID NO: 4974 - DNA, 27 bp; single-stranded, linear
  The letter "N" represents the stem II region of an HH ribozyme.
gauaggagcugaugangaaauguuucg

SEQ ID NO: 4975 - DNA, 27 bp; single-stranded, linear
  The letter "N" represents the stem II region of an HH ribozyme.
cgauaggacugaugangaaaauguuuc

SEQ ID NO: 4976 - DNA, 27 bp; single-stranded, linear
  The letter "N" represents the stem II region of an HH ribozyme.
uccgauagcugaugangaaagaauguu

SEQ ID NO: 4977 - DNA, 27 bp; single-stranded, linear
  The letter "N" represents the stem II region of an HH ribozyme.
uucuccgacugaugangaaaggagaau

SEQ ID NO: 4978 - DNA, 27 bp; single-stranded, linear
  The letter "N" represents the stem II region of an HH ribozyme.
ucuucucccugaugangaaauaggaga

SEQ ID NO: 4979 - DNA, 27 bp; single-stranded, linear
  The letter "N" represents the stem II region of an HH ribozyme.
cagaucuucugaugangaaaccacauu

SEQ ID NO: 4980 - DNA, 27 bp; single-stranded, linear
  The letter "N" represents the stem II region of an HH ribozyme.
acagaucucugaugangaaaaccacau

SEQ ID NO: 4981 - DNA, 27 bp; single-stranded, linear
  The letter "N" represents the stem II region of an HH ribozyme.
aagucacacugaugangaaaucuuaac

SEQ ID NO: 4982 - DNA, 27 bp; single-stranded, linear
  The letter "N" represents the stem II region of an HH ribozyme.
ccaagccgcugaugangaaagucacag

SEQ ID NO: 4983 - DNA, 27 bp; single-stranded, linear
  The letter "N" represents the stem II region of an HH ribozyme.
gccaagcccugaugangaaaagucaca

SEQ ID NO: 4984 - DNA, 27 bp; single-stranded, linear
  The letter "N" represents the stem II region of an HH ribozyme.
cccgggcccugaugangaaagccgaag

SEQ ID NO: 4985 - DNA, 27 bp; single-stranded, linear
  The letter "N" represents the stem II region of an HH ribozyme.
ucuuuauacugaugangaaaugucccg

SEQ ID NO: 4986 - DNA, 27 bp; single-stranded, linear
  The letter "N" represents the stem II region of an HH ribozyme.
gucuuuaucugaugangaaaauguccc

SEQ ID NO: 4987 - DNA, 27 bp; single-stranded, linear
  The letter "N" represents the stem II region of an HH ribozyme.
ggucuuuacugaugangaaaaaugucc

SEQ ID NO: 4988 - DNA, 27 bp; single-stranded, linear
  The letter "N" represents the stem II region of an HH ribozyme.
cgggucuucugaugangaaauaaaugu

SEQ ID NO: 4989 - DNA, 27 bp; single-stranded, linear
  The letter "N" represents the stem II region of an HH ribozyme.
ucugacaucugaugangaaauccgggu

SEQ ID NO: 4990 - DNA, 27 bp; single-stranded, linear
  The letter "N" represents the stem II region of an HH ribozyme.
uucugacacugaugangaaaauccggg

SEQ ID NO: 4991 - DNA, 27 bp; single-stranded, linear
  The letter "N" represents the stem II region of an HH ribozyme.
ccuuuucucugaugangaaacauaauc

SEQ ID NO: 4992 - DNA, 27 bp; single-stranded, linear
  The letter "N" represents the stem II region of an HH ribozyme.
uucaaaggcugaugangaaagucgggc

SEQ ID NO: 4993 - DNA, 27 bp; single-stranded, linear
  The letter "N" represents the stem II region of an HH ribozyme.
ccacuucacugaugangaaagggaguc

SEQ ID NO: 4994 - DNA, 27 bp; single-stranded, linear
  The letter "N" represents the stem II region of an HH ribozyme.
uccacuuccugaugangaaaagggagu

SEQ ID NO: 4995 - DNA, 27 bp; single-stranded, linear
  The letter "N" represents the stem II region of an HH ribozyme.
cugucaaacugaugangaaaugguuuc

SEQ ID NO: 4996 - DNA, 27 bp; single-stranded, linear
  The letter "N" represents the stem II region of an HH ribozyme.
ucugucaacugaugangaaaaugguuu

SEQ ID NO: 4997 - DNA, 27 bp; single-stranded, linear
  The letter "N" represents the stem II region of an HH ribozyme.
cucugucacugaugangaaaaaugguu

SEQ ID NO: 4998 - DNA, 27 bp; single-stranded, linear
  The letter "N" represents the stem II region of an HH ribozyme.
acucuguccugaugangaaaaaauggu

SEQ ID NO: 4999 - DNA, 27 bp; single-stranded, linear
  The letter "N" represents the stem II region of an HH ribozyme.
auuguguacugaugangaaacucuguc

SEQ ID NO: 5000 - DNA, 27 bp; single-stranded, linear
  The letter "N" represents the stem II region of an HH ribozyme.
gaauugugcugaugangaaauacucug

SEQ ID NO: 5001 - DNA, 27 bp; single-stranded, linear
  The letter "N" represents the stem II region of an HH ribozyme.
ucgcucugcugaugangaaauugugua

SEQ ID NO: 5002 - DNA, 27 bp; single-stranded, linear
  The letter "N" represents the stem II region of an HH ribozyme.
aucgcucucugaugangaaaauugugu

SEQ ID NO: 5003 - DNA, 27 bp; single-stranded, linear
  The letter "N" represents the stem II region of an HH ribozyme.
caccgaaacugaugangaaaccacaca

SEQ ID NO: 5004 - DNA, 27 bp; single-stranded, linear
  The letter "N" represents the stem II region of an HH ribozyme.
cacaccgacugaugangaaagaccaca

SEQ ID NO: 5005 - DNA, 27 bp; single-stranded, linear
  The letter "N" represents the stem II region of an HH ribozyme.
acacaccgcugaugangaaaagaccac

SEQ ID NO: 5006 - DNA, 27 bp; single-stranded, linear
  The letter "N" represents the stem II region of an HH ribozyme.
aacacacccugaugangaaaaagacca

SEQ ID NO: 5007 - DNA, 27 bp; single-stranded, linear
  The letter "N" represents the stem II region of an HH ribozyme.
cccagagccugaugangaaacacaccg

SEQ ID NO: 5008 - DNA, 27 bp; single-stranded, linear
  The letter "N" represents the stem II region of an HH ribozyme.
auuucccacugaugangaaagcaacac

SEQ ID NO: 5009 - DNA, 27 bp; single-stranded, linear
  The letter "N" represents the stem II region of an HH ribozyme.
aaggaaaacugaugangaaauuuccca

SEQ ID NO: 5010 - DNA, 27 bp; single-stranded, linear
  The letter "N" represents the stem II region of an HH ribozyme.
cuaaggaacugaugangaaauauuucc

SEQ ID NO: 5011 - DNA, 27 bp; single-stranded, linear
  The letter "N" represents the stem II region of an HH ribozyme.
ccuaaggacugaugangaaaauauuuc

SEQ ID NO: 5012 - DNA, 27 bp; single-stranded, linear
  The letter "N" represents the stem II region of an HH ribozyme.
accuaaggcugaugangaaaaauauuu

SEQ ID NO: 5013 - DNA, 27 bp; single-stranded, linear
  The letter "N" represents the stem II region of an HH ribozyme.
caccuaagcugaugangaaaaaauauu

SEQ ID NO: 5014 - DNA, 27 bp; single-stranded, linear
  The letter "N" represents the stem II region of an HH ribozyme.
aggcaccucugaugangaaaggaaaau

SEQ ID NO: 5015 - DNA, 27 bp; single-stranded, linear
  The letter "N" represents the stem II region of an HH ribozyme.
gaggcacccugaugangaaaaggaaaa

SEQ ID NO: 5016 - DNA, 27 bp; single-stranded, linear
  The letter "N" represents the stem II region of an HH ribozyme.
gguaugggcugaugangaaaggcaccu

SEQ ID NO: 5017 - DNA, 27 bp; single-stranded, linear
  The letter "N" represents the stem II region of an HH ribozyme.
ccccagggcugaugangaaauggggag

SEQ ID NO: 5018 - DNA, 27 bp; single-stranded, linear
  The letter "N" represents the stem II region of an HH ribozyme.
ucaaucuucugaugangaaaccccagg

SEQ ID NO: 5019 - DNA, 27 bp; single-stranded, linear
  The letter "N" represents the stem II region of an HH ribozyme.
ucuucauccugaugangaaaucuugac

SEQ ID NO: 5020 - DNA, 27 bp; single-stranded, linear
  The letter "N" represents the stem II region of an HH ribozyme.
uccuacaacugaugangaaauucuuca

SEQ ID NO: 5021 - DNA, 27 bp; single-stranded, linear
  The letter "N" represents the stem II region of an HH ribozyme.
cuccuacacugaugangaaaauucuuc

SEQ ID NO: 5022 - DNA, 27 bp; single-stranded, linear
  The letter "N" represents the stem II region of an HH ribozyme.
ucuccuaccugaugangaaaaauucuu

SEQ ID NO: 5023 - DNA, 27 bp; single-stranded, linear
  The letter "N" represents the stem II region of an HH ribozyme.
caaucucccugaugangaaacaaaauu

SEQ ID NO: 5024 - DNA, 27 bp; single-stranded, linear
  The letter "N" represents the stem II region of an HH ribozyme.
cuucuuuccugaugangaaaucuccua

SEQ ID NO: 5025 - DNA, 27 bp; single-stranded, linear
  The letter "N" represents the stem II region of an HH ribozyme.
ccgcauuccugaugangaaaguuccuu

SEQ ID NO: 5026 - DNA, 27 bp; single-stranded, linear
  The letter "N" represents the stem II region of an HH ribozyme.
guagucagcugaugangaaagcccgca

SEQ ID NO: 5027 - DNA, 27 bp; single-stranded, linear
  The letter "N" represents the stem II region of an HH ribozyme.
ggguagugcugaugangaaagucagga

SEQ ID NO: 5028 - DNA, 27 bp; single-stranded, linear
  The letter "N" represents the stem II region of an HH ribozyme.
uucuggggcugaugangaaaguguagu

SEQ ID NO: 5029 - DNA, 27 bp; single-stranded, linear
  The letter "N" represents the stem II region of an HH ribozyme.
uggucuggcugaugangaaacauuucu

SEQ ID NO: 5030 - DNA, 27 bp; single-stranded, linear
  The letter "N" represents the stem II region of an HH ribozyme.
cugaaaaccugaugangaaagggucuc

SEQ ID NO: 5031 - DNA, 27 bp; single-stranded, linear
  The letter "N" represents the stem II region of an HH ribozyme.
acucugaacugaugangaaacgagggu

SEQ ID NO: 5032 - DNA, 27 bp; single-stranded, linear
  The letter "N" represents the stem II region of an HH ribozyme.
aacucugacugaugangaaaacgaggg

SEQ ID NO: 5033 - DNA, 27 bp; single-stranded, linear
  The letter "N" represents the stem II region of an HH ribozyme.
caacucugcugaugangaaaaacgagg

SEQ ID NO: 5034 - DNA, 27 bp; single-stranded, linear
  The letter "N" represents the stem II region of an HH ribozyme.
ccaacucucugaugangaaaaaacgag

SEQ ID NO: 5035 - DNA, 27 bp; single-stranded, linear
  The letter "N" represents the stem II region of an HH ribozyme.
gcuccacccugaugangaaacucugaa

SEQ ID NO: 5036 - DNA, 27 bp; single-stranded, linear
  The letter "N" represents the stem II region of an HH ribozyme.
guuucccacugaugangaaaugcucca

SEQ ID NO: 5037 - DNA, 27 bp; single-stranded, linear
  The letter "N" represents the stem II region of an HH ribozyme.
gguuuccccugaugangaaaaugcucc

SEQ ID NO: 5038 - DNA, 27 bp; single-stranded, linear
  The letter "N" represents the stem II region of an HH ribozyme.
gcuugcagcugaugangaaagguuucc

SEQ ID NO: 5039 - DNA, 27 bp; single-stranded, linear
  The letter "N" represents the stem II region of an HH ribozyme.
gaacaauacugaugangaaagucuuug

SEQ ID NO: 5040 - DNA, 27 bp; single-stranded, linear
  The letter "N" represents the stem II region of an HH ribozyme.
aagaacaacugaugangaaauagucuu

SEQ ID NO: 5041 - DNA, 27 bp; single-stranded, linear
  The letter "N" represents the stem II region of an HH ribozyme.
ggaagaaccugaugangaaauauaguc

SEQ ID NO: 5042 - DNA, 27 bp; single-stranded, linear
  The letter "N" represents the stem II region of an HH ribozyme.
auuggaagcugaugangaaacaauaua

SEQ ID NO: 5043 - DNA, 27 bp; single-stranded, linear
  The letter "N" represents the stem II region of an HH ribozyme.
cauuggaacugaugangaaaacaauau

SEQ ID NO: 5044 - DNA, 27 bp; single-stranded, linear
  The letter "N" represents the stem II region of an HH ribozyme.
gacauuggcugaugangaaagaacaau

SEQ ID NO: 5045 - DNA, 27 bp; single-stranded, linear
  The letter "N" represents the stem II region of an HH ribozyme.
ugacauugcugaugangaaaagaacaa

SEQ ID NO: 5046 - DNA, 27 bp; single-stranded, linear
  The letter "N" represents the stem II region of an HH ribozyme.
gugucucucugaugangaaacauugga

SEQ ID NO: 5047 - DNA, 27 bp; single-stranded, linear
  The letter "N" represents the stem II region of an HH ribozyme.
gaguccagcugaugangaaauccucuu

SEQ ID NO: 5048 - DNA, 27 bp; single-stranded, linear
  The letter "N" represents the stem II region of an HH ribozyme.
agaguccacugaugangaaaauccucu

SEQ ID NO: 5049 - DNA, 27 bp; single-stranded, linear
  The letter "N" represents the stem II region of an HH ribozyme.
ggcagggacugaugangaaaguccaga

SEQ ID NO: 5050 - DNA, 27 bp; single-stranded, linear
  The letter "N" represents the stem II region of an HH ribozyme.
uaggcaggcugaugangaaagagucca

SEQ ID NO: 5051 - DNA, 27 bp; single-stranded, linear
  The letter "N" represents the stem II region of an HH ribozyme.
aggugaggcugaugangaaaggcaggg

SEQ ID NO: 5052 - DNA, 27 bp; single-stranded, linear
  The letter "N" represents the stem II region of an HH ribozyme.
aaacaggucugaugangaaagguaggc

SEQ ID NO: 5053 - DNA, 27 bp; single-stranded, linear
  The letter "N" represents the stem II region of an HH ribozyme.
auacaggacugaugangaaacagguga

SEQ ID NO: 5054 - DNA, 27 bp; single-stranded, linear
  The letter "N" represents the stem II region of an HH ribozyme.
cauacaggcugaugangaaaacaggug

SEQ ID NO: 5055 - DNA, 27 bp; single-stranded, linear
  The letter "N" represents the stem II region of an HH ribozyme.
ccauacagcugaugangaaaaacaggu

SEQ ID NO: 5056 - DNA, 27 bp; single-stranded, linear
  The letter "N" represents the stem II region of an HH ribozyme.
uuccuccacugaugangaaacaggaaa

SEQ ID NO: 5057 - DNA, 27 bp; single-stranded, linear
  The letter "N" represents the stem II region of an HH ribozyme.
cauaauggcugaugangaaauuugggg

SEQ ID NO: 5058 - DNA, 27 bp; single-stranded, linear
  The letter "N" represents the stem II region of an HH ribozyme.
ucauaaugcugaugangaaaauuuggg

SEQ ID NO: 5059 - DNA, 27 bp; single-stranded, linear
  The letter "N" represents the stem II region of an HH ribozyme.
guugucaucugaugangaaauggaauu

SEQ ID NO: 5060 - DNA, 27 bp; single-stranded, linear
  The letter "N" represents the stem II region of an HH ribozyme.
uguugucacugaugangaaaauggaau

SEQ ID NO: 5061 - DNA, 27 bp; single-stranded, linear
  The letter "N" represents the stem II region of an HH ribozyme.
uaaugacucugaugangaaauuccugc

SEQ ID NO: 5062 - DNA, 27 bp; single-stranded, linear
  The letter "N" represents the stem II region of an HH ribozyme.
gagauaaucugaugangaaacugauuc

SEQ ID NO: 5063 - DNA, 27 bp; single-stranded, linear
  The letter "N" represents the stem II region of an HH ribozyme.
cuggagaucugaugangaaaugacuga

SEQ ID NO: 5064 - DNA, 27 bp; single-stranded, linear
  The letter "N" represents the stem II region of an HH ribozyme.
ucuggagacugaugangaaaaugacug

SEQ ID NO: 5065 - DNA, 27 bp; single-stranded, linear
  The letter "N" represents the stem II region of an HH ribozyme.
guucuggacugaugangaaauaaugac

SEQ ID NO: 5066 - DNA, 27 bp; single-stranded, linear
  The letter "N" represents the stem II region of an HH ribozyme.
cuguucugcugaugangaaagauaaug

SEQ ID NO: 5067 - DNA, 27 bp; single-stranded, linear
  The letter "N" represents the stem II region of an HH ribozyme.
cuuucgcucugaugangaaacuguucu

SEQ ID NO: 5068 - DNA, 27 bp; single-stranded, linear
  The letter "N" represents the stem II region of an HH ribozyme.
aauguuuucugaugangaaacacucac

SEQ ID NO: 5069 - DNA, 27 bp; single-stranded, linear
  The letter "N" represents the stem II region of an HH ribozyme.
uaucuucacugaugangaaauguuuuu

SEQ ID NO: 5070 - DNA, 27 bp; single-stranded, linear
  The letter "N" represents the stem II region of an HH ribozyme.
auaucuuccugaugangaaaauguuuu

SEQ ID NO: 5071 - DNA, 27 bp; single-stranded, linear
  The letter "N" represents the stem II region of an HH ribozyme.
caaugggacugaugangaaaucuucaa

SEQ ID NO: 5072 - DNA, 27 bp; single-stranded, linear
  The letter "N" represents the stem II region of an HH ribozyme.
uccaauggcugaugangaaauaucuuc

SEQ ID NO: 5073 - DNA, 27 bp; single-stranded, linear
  The letter "N" represents the stem II region of an HH ribozyme.
guuccucccugaugangaaaugggaua

SEQ ID NO: 5074 - DNA, 27 bp; single-stranded, linear
  The letter "N" represents the stem II region of an HH ribozyme.
aucacuuucugaugangaaacuucugg

SEQ ID NO: 5075 - DNA, 27 bp; single-stranded, linear
  The letter "N" represents the stem II region of an HH ribozyme.
ucaucuggcugaugangaaaucacuuu

SEQ ID NO: 5076 - DNA, 27 bp; single-stranded, linear
  The letter "N" represents the stem II region of an HH ribozyme.
gaugcaagcugaugangaaaccauccc

SEQ ID NO: 5077 - DNA, 27 bp; single-stranded, linear
  The letter "N" represents the stem II region of an HH ribozyme.
ucugaugccugaugangaaaggaccau

SEQ ID NO: 5078 - DNA, 27 bp; single-stranded, linear
  The letter "N" represents the stem II region of an HH ribozyme.
gcucuucucugaugangaaaugcaagg

SEQ ID NO: 5079 - DNA, 27 bp; single-stranded, linear
  The letter "N" represents the stem II region of an HH ribozyme.
gucuuccacugaugangaaaguuuuca

SEQ ID NO: 5080 - DNA, 27 bp; single-stranded, linear
  The letter "N" represents the stem II region of an HH ribozyme.
auggagaucugaugangaaauuuguuc

SEQ ID NO: 5081 - DNA, 27 bp; single-stranded, linear
  The letter "N" represents the stem II region of an HH ribozyme.
gauggagacugaugangaaaauuuguu

SEQ ID NO: 5082 - DNA, 27 bp; single-stranded, linear
  The letter "N" represents the stem II region of an HH ribozyme.
aagauggacugaugangaaauaauuug

SEQ ID NO: 5083 - DNA, 27 bp; single-stranded, linear
  The letter "N" represents the stem II region of an HH ribozyme.
aaaagaugcugaugangaaagauaauu

SEQ ID NO: 5084 - DNA, 27 bp; single-stranded, linear
  The letter "N" represents the stem II region of an HH ribozyme.
caccaaaacugaugangaaauggagau

SEQ ID NO: 5085 - DNA, 27 bp; single-stranded, linear
  The letter "N" represents the stem II region of an HH ribozyme.
uccaccaacugaugangaaagauggag

SEQ ID NO: 5086 - DNA, 27 bp; single-stranded, linear
  The letter "N" represents the stem II region of an HH ribozyme.
uuccaccacugaugangaaaagaugga

SEQ ID NO: 5087 - DNA, 27 bp; single-stranded, linear
  The letter "N" represents the stem II region of an HH ribozyme.
auuccacccugaugangaaaaagaugg

SEQ ID NO: 5088 - DNA, 27 bp; single-stranded, linear
  The letter "N" represents the stem II region of an HH ribozyme.
ccugcuuucugaugangaaacugggca

SEQ ID NO: 5089 - DNA, 27 bp; single-stranded, linear
  The letter "N" represents the stem II region of an HH ribozyme.
aggccacacugaugangaaacucccug

SEQ ID NO: 5090 - DNA, 27 bp; single-stranded, linear
  The letter "N" represents the stem II region of an HH ribozyme.
agccuucccugaugangaaaggccaca

SEQ ID NO: 5091 - DNA, 27 bp; single-stranded, linear
  The letter "N" represents the stem II region of an HH ribozyme.
ucugguugcugaugangaaagccuucc

SEQ ID NO: 5092 - DNA, 27 bp; single-stranded, linear
  The letter "N" represents the stem II region of an HH ribozyme.
cagacuggcugaugangaaagccacug

SEQ ID NO: 5093 - DNA, 27 bp; single-stranded, linear
  The letter "N" represents the stem II region of an HH ribozyme.
gauacccacugaugangaaacugguag

SEQ ID NO: 5094 - DNA, 27 bp; single-stranded, linear
  The letter "N" represents the stem II region of an HH ribozyme.
cugagugacugaugangaaacccagac

SEQ ID NO: 5095 - DNA, 27 bp; single-stranded, linear
  The letter "N" represents the stem II region of an HH ribozyme.
aucugagucugaugangaaauacccag

SEQ ID NO: 5096 - DNA, 27 bp; single-stranded, linear
  The letter "N" represents the stem II region of an HH ribozyme.
ugucaucucugaugangaaagugauac

SEQ ID NO: 5097 - DNA, 27 bp; single-stranded, linear
  The letter "N" represents the stem II region of an HH ribozyme.
cgcuggagcugaugangaaacacggug

SEQ ID NO: 5098 - DNA, 27 bp; single-stranded, linear
  The letter "N" represents the stem II region of an HH ribozyme.
cgucgcugcugaugangaaaguacacg

SEQ ID NO: 5099 - DNA, 27 bp; single-stranded, linear
  The letter "N" represents the stem II region of an HH ribozyme.
aucuuuaacugaugangaaaguccugc

SEQ ID NO: 5100 - DNA, 27 bp; single-stranded, linear
  The letter "N" represents the stem II region of an HH ribozyme.
caucuuuacugaugangaaaaguccug

SEQ ID NO: 5101 - DNA, 27 bp; single-stranded, linear
  The letter "N" represents the stem II region of an HH ribozyme.
ccaucuuucugaugangaaaaaguccu

SEQ ID NO: 5102 - DNA, 27 bp; single-stranded, linear
  The letter "N" represents the stem II region of an HH ribozyme.
accaucuucugaugangaaaaaagucc

SEQ ID NO: 5103 - DNA, 27 bp; single-stranded, linear
  The letter "N" represents the stem II region of an HH ribozyme.
ucagcgugcugaugangaaacugcagc

SEQ ID NO: 5104 - DNA, 27 bp; single-stranded, linear
  The letter "N" represents the stem II region of an HH ribozyme.
gucagcgucugaugangaaaacugcag

SEQ ID NO: 5105 - DNA, 27 bp; single-stranded, linear
  The letter "N" represents the stem II region of an HH ribozyme.
uggucccucugaugangaaagucagcg

SEQ ID NO: 5106 - DNA, 27 bp; single-stranded, linear
  The letter "N" represents the stem II region of an HH ribozyme.
caggaggucugaugangaaagcugcag

SEQ ID NO: 5107 - DNA, 27 bp; single-stranded, linear
  The letter "N" represents the stem II region of an HH ribozyme.
uuaaacagcugaugangaaaggugagc

SEQ ID NO: 5108 - DNA, 27 bp; single-stranded, linear
  The letter "N" represents the stem II region of an HH ribozyme.
uccauuuacugaugangaaacaggagg

SEQ ID NO: 5109 - DNA, 27 bp; single-stranded, linear
  The letter "N" represents the stem II region of an HH ribozyme.
uuccauuucugaugangaaaacaggag

SEQ ID NO: 5110 - DNA, 27 bp; single-stranded, linear
  The letter "N" represents the stem II region of an HH ribozyme.
cuuccauucugaugangaaaaacagga

SEQ ID NO: 5111 - DNA, 27 bp; single-stranded, linear
  The letter "N" represents the stem II region of an HH ribozyme.
cgggacagcugaugangaaaccacuuc

SEQ ID NO: 5112 - DNA, 27 bp; single-stranded, linear
  The letter "N" represents the stem II region of an HH ribozyme.
ggagccggcugaugangaaacaggacc

SEQ ID NO: 5113 - DNA, 27 bp; single-stranded, linear
  The letter "N" represents the stem II region of an HH ribozyme.
ugggggcgcugaugangaaagccggga

SEQ ID NO: 5114 - DNA, 27 bp; single-stranded, linear
  The letter "N" represents the stem II region of an HH ribozyme.
auuuccagcugaugangaaaguugggg

SEQ ID NO: 5115 - DNA, 27 bp; single-stranded, linear
  The letter "N" represents the stem II region of an HH ribozyme.
ucucucgucugaugangaaauuuccag

SEQ ID NO: 5116 - DNA, 27 bp; single-stranded, linear
  The letter "N" represents the stem II region of an HH ribozyme.
gaaaaucucugaugangaaagcagcac

SEQ ID NO: 5117 - DNA, 27 bp; single-stranded, linear
  The letter "N" represents the stem II region of an HH ribozyme.
ugaaaauccugaugangaaaagcagca

SEQ ID NO: 5118 - DNA, 27 bp; single-stranded, linear
  The letter "N" represents the stem II region of an HH ribozyme.
cacuugaacugaugangaaaucuaagc

SEQ ID NO: 5119 - DNA, 27 bp; single-stranded, linear
  The letter "N" represents the stem II region of an HH ribozyme.
acacuugacugaugangaaaaucuaag

SEQ ID NO: 5120 - DNA, 27 bp; single-stranded, linear
  The letter "N" represents the stem II region of an HH ribozyme.
aacacuugcugaugangaaaaaucuaa

SEQ ID NO: 5121 - DNA, 27 bp; single-stranded, linear
  The letter "N" represents the stem II region of an HH ribozyme.
caacacuucugaugangaaaaaaucua

SEQ ID NO: 5122 - DNA, 27 bp; single-stranded, linear
  The letter "N" represents the stem II region of an HH ribozyme.
gaaagaaccugaugangaaacacuuga

SEQ ID NO: 5123 - DNA, 27 bp; single-stranded, linear
  The letter "N" represents the stem II region of an HH ribozyme.
guggaaagcugaugangaaacaacacu

SEQ ID NO: 5124 - DNA, 27 bp; single-stranded, linear
  The letter "N" represents the stem II region of an HH ribozyme.
gguggaaacugaugangaaaacaacac

SEQ ID NO: 5125 - DNA, 27 bp; single-stranded, linear
  The letter "N" represents the stem II region of an HH ribozyme.
gugguggacugaugangaaagaacaac

SEQ ID NO: 5126 - DNA, 27 bp; single-stranded, linear
  The letter "N" represents the stem II region of an HH ribozyme.
ggugguggcugaugangaaaagaacaa

SEQ ID NO: 5127 - DNA, 27 bp; single-stranded, linear
  The letter "N" represents the stem II region of an HH ribozyme.
ggguggugcugaugangaaaaagaaca

SEQ ID NO: 5128 - DNA, 27 bp; single-stranded, linear
  The letter "N" represents the stem II region of an HH ribozyme.
aauguggccugaugangaaacuuccgg

SEQ ID NO: 5129 - DNA, 27 bp; single-stranded, linear
  The letter "N" represents the stem II region of an HH ribozyme.
gaaaaucacugaugangaaauguggcu

SEQ ID NO: 5130 - DNA, 27 bp; single-stranded, linear
  The letter "N" represents the stem II region of an HH ribozyme.
ugaaaauccugaugangaaaauguggc

SEQ ID NO: 5131 - DNA, 27 bp; single-stranded, linear
  The letter "N" represents the stem II region of an HH ribozyme.
aaaaugaacugaugangaaaucaaaug

SEQ ID NO: 5132 - DNA, 27 bp; single-stranded, linear
  The letter "N" represents the stem II region of an HH ribozyme.
aaaaaugacugaugangaaaaucaaau

SEQ ID NO: 5133 - DNA, 27 bp; single-stranded, linear
  The letter "N" represents the stem II region of an HH ribozyme.
caaaaaugcugaugangaaaaaucaaa

SEQ ID NO: 5134 - DNA, 27 bp; single-stranded, linear
  The letter "N" represents the stem II region of an HH ribozyme.
ccaaaaaucugaugangaaaaaaucaa

SEQ ID NO: 5135 - DNA, 27 bp; single-stranded, linear
  The letter "N" represents the stem II region of an HH ribozyme.
ccuccaaacugaugangaaaugaaaau

SEQ ID NO: 5136 - DNA, 27 bp; single-stranded, linear
  The letter "N" represents the stem II region of an HH ribozyme.
uccuccaacugaugangaaaaugaaaa

SEQ ID NO: 5137 - DNA, 27 bp; single-stranded, linear
  The letter "N" represents the stem II region of an HH ribozyme.
cuccuccacugaugangaaaaaugaaa

SEQ ID NO: 5138 - DNA, 27 bp; single-stranded, linear
  The letter "N" represents the stem II region of an HH ribozyme.
ccuccucccugaugangaaaaaaugaa

SEQ ID NO: 5139 - DNA, 27 bp; single-stranded, linear
  The letter "N" represents the stem II region of an HH ribozyme.
ugcagucucugaugangaaaggucccu

SEQ ID NO: 5140 - DNA, 27 bp; single-stranded, linear
  The letter "N" represents the stem II region of an HH ribozyme.
cugaggaccugaugangaaagcuccuu

SEQ ID NO: 5141 - DNA, 27 bp; single-stranded, linear
  The letter "N" represents the stem II region of an HH ribozyme.
gcccugagcugaugangaaacaagcuc

SEQ ID NO: 5142 - DNA, 27 bp; single-stranded, linear
  The letter "N" represents the stem II region of an HH ribozyme.
aaugcccucugaugangaaaggacaag

SEQ ID NO: 5143 - DNA, 27 bp; single-stranded, linear
  The letter "N" represents the stem II region of an HH ribozyme.
ucucuggacugaugangaaaugcccug

SEQ ID NO: 5144 - DNA, 27 bp; single-stranded, linear
  The letter "N" represents the stem II region of an HH ribozyme.
uucucuggcugaugangaaaaugcccu

SEQ ID NO: 5145 - DNA, 27 bp; single-stranded, linear
  The letter "N" represents the stem II region of an HH ribozyme.
cuucucugcugaugangaaaaaugccc

SEQ ID NO: 5146 - DNA, 27 bp; single-stranded, linear
  The letter "N" represents the stem II region of an HH ribozyme.
guagaguccugaugangaaacacauuc

SEQ ID NO: 5147 - DNA, 27 bp; single-stranded, linear
  The letter "N" represents the stem II region of an HH ribozyme.
agagaguacugaugangaaagucaaca

SEQ ID NO: 5148 - DNA, 27 bp; single-stranded, linear
  The letter "N" represents the stem II region of an HH ribozyme.
aaagagagcugaugangaaagagucaa

SEQ ID NO: 5149 - DNA, 27 bp; single-stranded, linear
  The letter "N" represents the stem II region of an HH ribozyme.
ggaaaagacugaugangaaaguagagu

SEQ ID NO: 5150 - DNA, 27 bp; single-stranded, linear
  The letter "N" represents the stem II region of an HH ribozyme.
auggaaaacugaugangaaagaguaga

SEQ ID NO: 5151 - DNA, 27 bp; single-stranded, linear
  The letter "N" represents the stem II region of an HH ribozyme.
gaauggaacugaugangaaagagagua

SEQ ID NO: 5152 - DNA, 27 bp; single-stranded, linear
  The letter "N" represents the stem II region of an HH ribozyme.
ugaauggacugaugangaaaagagagu

SEQ ID NO: 5153 - DNA, 27 bp; single-stranded, linear
  The letter "N" represents the stem II region of an HH ribozyme.
augaauggcugaugangaaaaagagag

SEQ ID NO: 5154 - DNA, 27 bp; single-stranded, linear
  The letter "N" represents the stem II region of an HH ribozyme.
aaugaaugcugaugangaaaaaagaga

SEQ ID NO: 5155 - DNA, 27 bp; single-stranded, linear
  The letter "N" represents the stem II region of an HH ribozyme.
uuuaaaugcugaugangaaauggaaaa

SEQ ID NO: 5156 - DNA, 27 bp; single-stranded, linear
  The letter "N" represents the stem II region of an HH ribozyme.
uuuuaaaucugaugangaaaauggaaa

SEQ ID NO: 5157 - DNA, 27 bp; single-stranded, linear
  The letter "N" represents the stem II region of an HH ribozyme.
gacuuuuacugaugangaaaugaaugg

SEQ ID NO: 5158 - DNA, 27 bp; single-stranded, linear
  The letter "N" represents the stem II region of an HH ribozyme.
ggacuuuucugaugangaaaaugaaug

SEQ ID NO: 5159 - DNA, 27 bp; single-stranded, linear
  The letter "N" represents the stem II region of an HH ribozyme.
aggacuuucugaugangaaaaaugaau

SEQ ID NO: 5160 - DNA, 27 bp; single-stranded, linear
  The letter "N" represents the stem II region of an HH ribozyme.
uuauauagcugaugangaaacuuuuaa

SEQ ID NO: 5161 - DNA, 27 bp; single-stranded, linear
  The letter "N" represents the stem II region of an HH ribozyme.
acauuauacugaugangaaaggacuuu

SEQ ID NO: 5162 - DNA, 27 bp; single-stranded, linear
  The letter "N" represents the stem II region of an HH ribozyme.
gcacauuacugaugangaaauaggacu

SEQ ID NO: 5163 - DNA, 27 bp; single-stranded, linear
  The letter "N" represents the stem II region of an HH ribozyme.
gggcacaucugaugangaaauauagga

SEQ ID NO: 5164 - DNA, 27 bp; single-stranded, linear
  The letter "N" represents the stem II region of an HH ribozyme.
gguagugacugaugangaaaccacagc

SEQ ID NO: 5165 - DNA, 27 bp; single-stranded, linear
  The letter "N" represents the stem II region of an HH ribozyme.
cugguagucugaugangaaagaccaca

SEQ ID NO: 5166 - DNA, 27 bp; single-stranded, linear
  The letter "N" represents the stem II region of an HH ribozyme.
uuaacuggcugaugangaaagugagac

SEQ ID NO: 5167 - DNA, 27 bp; single-stranded, linear
  The letter "N" represents the stem II region of an HH ribozyme.
uuugcuuucugaugangaaacugguag

SEQ ID NO: 5168 - DNA, 27 bp; single-stranded, linear
  The letter "N" represents the stem II region of an HH ribozyme.
uuuugcuucugaugangaaaacuggua

SEQ ID NO: 5169 - DNA, 27 bp; single-stranded, linear
  The letter "N" represents the stem II region of an HH ribozyme.
guguuugacugaugangaaagucuuuu

SEQ ID NO: 5170 - DNA, 27 bp; single-stranded, linear
  The letter "N" represents the stem II region of an HH ribozyme.
cguguuugcugaugangaaaagucuuu

SEQ ID NO: 5171 - DNA, 27 bp; single-stranded, linear
  The letter "N" represents the stem II region of an HH ribozyme.
acguguuucugaugangaaaaagucuu

SEQ ID NO: 5172 - DNA, 27 bp; single-stranded, linear
  The letter "N" represents the stem II region of an HH ribozyme.
ggaggacacugaugangaaaguccacg

SEQ ID NO: 5173 - DNA, 27 bp; single-stranded, linear
  The letter "N" represents the stem II region of an HH ribozyme.
ucuuggagcugaugangaaacagaguc

SEQ ID NO: 5174 - DNA, 27 bp; single-stranded, linear
  The letter "N" represents the stem II region of an HH ribozyme.
acuucuugcugaugangaaaggacaga

SEQ ID NO: 5175 - DNA, 27 bp; single-stranded, linear
  The letter "N" represents the stem II region of an HH ribozyme.
guuucacacugaugangaaaggugccg

SEQ ID NO: 5176 - DNA, 27 bp; single-stranded, linear
  The letter "N" represents the stem II region of an HH ribozyme.
gcccauuccugaugangaaauccaguu

SEQ ID NO: 5177 - DNA, 27 bp; single-stranded, linear
  The letter "N" represents the stem II region of an HH ribozyme.
aacacacacugaugangaaagcauugc

SEQ ID NO: 5178 - DNA, 27 bp; single-stranded, linear
  The letter "N" represents the stem II region of an HH ribozyme.
caacacaccugaugangaaaagcauug

SEQ ID NO: 5179 - DNA, 27 bp; single-stranded, linear
  The letter "N" represents the stem II region of an HH ribozyme.
ccauccuccugaugangaaacacacaa

SEQ ID NO: 5180 - DNA, 27 bp; single-stranded, linear
  The letter "N" represents the stem II region of an HH ribozyme.
ggcccuggcugaugangaaacaucuca

SEQ ID NO: 5181 - DNA, 27 bp; single-stranded, linear
  The letter "N" represents the stem II region of an HH ribozyme.
gguagacacugaugangaaacucggcc

SEQ ID NO: 5182 - DNA, 27 bp; single-stranded, linear
  The letter "N" represents the stem II region of an HH ribozyme.
ccaagguacugaugangaaacagacuc

SEQ ID NO: 5183 - DNA, 27 bp; single-stranded, linear
  The letter "N" represents the stem II region of an HH ribozyme.
cuccaaggcugaugangaaagacagac

SEQ ID NO: 5184 - DNA, 27 bp; single-stranded, linear
  The letter "N" represents the stem II region of an HH ribozyme.
aagccucccugaugangaaagguagac

SEQ ID NO: 5185 - DNA, 27 bp; single-stranded, linear
  The letter "N" represents the stem II region of an HH ribozyme.
ccuccacacugaugangaaagccucca

SEQ ID NO: 5186 - DNA, 27 bp; single-stranded, linear
  The letter "N" represents the stem II region of an HH ribozyme.
uccuccaccugaugangaaaagccucc

SEQ ID NO: 5187 - DNA, 27 bp; single-stranded, linear
  The letter "N" represents the stem II region of an HH ribozyme.
uuggcucacugaugangaaagcccgca

SEQ ID NO: 5188 - DNA, 27 bp; single-stranded, linear
  The letter "N" represents the stem II region of an HH ribozyme.
ccacacuucugaugangaaacacuugg

SEQ ID NO: 5189 - DNA, 27 bp; single-stranded, linear
  The letter "N" represents the stem II region of an HH ribozyme.
cccacacucugaugangaaaacacuug

SEQ ID NO: 5190 - DNA, 27 bp; single-stranded, linear
  The letter "N" represents the stem II region of an HH ribozyme.
cuccgagccugaugangaaacuugcgc

SEQ ID NO: 5191 - DNA, 27 bp; single-stranded, linear
  The letter "N" represents the stem II region of an HH ribozyme.
cgcucucccugaugangaaagcgacuu

SEQ ID NO: 5192 - DNA, 27 bp; single-stranded, linear
  The letter "N" represents the stem II region of an HH ribozyme.
caggcucccugaugangaaaccgcucu

SEQ ID NO: 5193 - DNA, 27 bp; single-stranded, linear
  The letter "N" represents the stem II region of an HH ribozyme.
gccagcaccugaugangaaaugcaucu

SEQ ID NO: 5194 - DNA, 27 bp; single-stranded, linear
  The letter "N" represents the stem II region of an HH ribozyme.
cuccaccacugaugangaaagccagca

SEQ ID NO: 5195 - DNA, 27 bp; single-stranded, linear
  The letter "N" represents the stem II region of an HH ribozyme.
caggccaccugaugangaaagcccacc

SEQ ID NO: 5196 - DNA, 27 bp; single-stranded, linear
  The letter "N" represents the stem II region of an HH ribozyme.
cguuuccucugaugangaaacaggcca

SEQ ID NO: 5197 - DNA, 27 bp; single-stranded, linear
  The letter "N" represents the stem II region of an HH ribozyme.
caaaaccacugaugangaaacccugcc

SEQ ID NO: 5198 - DNA, 27 bp; single-stranded, linear
  The letter "N" represents the stem II region of an HH ribozyme.
ccaaaacccugaugangaaaacccugc

SEQ ID NO: 5199 - DNA, 27 bp; single-stranded, linear
  The letter "N" represents the stem II region of an HH ribozyme.
ccuuccaacugaugangaaaccaaacc

SEQ ID NO: 5200 - DNA, 27 bp; single-stranded, linear
  The letter "N" represents the stem II region of an HH ribozyme.
accuuccacugaugangaaaaccaaac

SEQ ID NO: 5201 - DNA, 27 bp; single-stranded, linear
  The letter "N" represents the stem II region of an HH ribozyme.
aaccuucccugaugangaaaaaccaaa

SEQ ID NO: 5202 - DNA, 27 bp; single-stranded, linear
  The letter "N" represents the stem II region of an HH ribozyme.
agcacgcacugaugangaaaccuucca

SEQ ID NO: 5203 - DNA, 27 bp; single-stranded, linear
  The letter "N" represents the stem II region of an HH ribozyme.
gagcacgccugaugangaaaaccuucc

SEQ ID NO: 5204 - DNA, 27 bp; single-stranded, linear
  The letter "N" represents the stem II region of an HH ribozyme.
acugugaacugaugangaaagcacgca

SEQ ID NO: 5205 - DNA, 27 bp; single-stranded, linear
  The letter "N" represents the stem II region of an HH ribozyme.
cgacugugcugaugangaaagagcacg

SEQ ID NO: 5206 - DNA, 27 bp; single-stranded, linear
  The letter "N" represents the stem II region of an HH ribozyme.
ccgacugucugaugangaaaagagcac

SEQ ID NO: 5207 - DNA, 27 bp; single-stranded, linear
  The letter "N" represents the stem II region of an HH ribozyme.
uguaaccccugaugangaaacugugaa

SEQ ID NO: 5208 - DNA, 27 bp; single-stranded, linear
  The letter "N" represents the stem II region of an HH ribozyme.
ucgccugucugaugangaaacccgacu

SEQ ID NO: 5209 - DNA, 27 bp; single-stranded, linear
  The letter "N" represents the stem II region of an HH ribozyme.
cucgccugcugaugangaaaacccgac

SEQ ID NO: 5210 - DNA, 27 bp; single-stranded, linear
  The letter "N" represents the stem II region of an HH ribozyme.
ccacagggcugaugangaaacucgccu

SEQ ID NO: 5211 - DNA, 27 bp; single-stranded, linear
  The letter "N" represents the stem II region of an HH ribozyme.
gccacaggcugaugangaaaacucgcc

SEQ ID NO: 5212 - DNA, 27 bp; single-stranded, linear
  The letter "N" represents the stem II region of an HH ribozyme.
gaguaggacugaugangaaacgccaca

SEQ ID NO: 5213 - DNA, 27 bp; single-stranded, linear
  The letter "N" represents the stem II region of an HH ribozyme.
ggaguaggcugaugangaaaacgccac

SEQ ID NO: 5214 - DNA, 27 bp; single-stranded, linear
  The letter "N" represents the stem II region of an HH ribozyme.
aggaguagcugaugangaaaaacgcca

SEQ ID NO: 5215 - DNA, 27 bp; single-stranded, linear
  The letter "N" represents the stem II region of an HH ribozyme.
auuaggagcugaugangaaaggaaacg

SEQ ID NO: 5216 - DNA, 27 bp; single-stranded, linear
  The letter "N" represents the stem II region of an HH ribozyme.
cucauuagcugaugangaaaguaggaa

SEQ ID NO: 5217 - DNA, 27 bp; single-stranded, linear
  The letter "N" represents the stem II region of an HH ribozyme.
acucucaucugaugangaaaggaguag

SEQ ID NO: 5218 - DNA, 27 bp; single-stranded, linear
  The letter "N" represents the stem II region of an HH ribozyme.
ccggaaggcugaugangaaacucucau

SEQ ID NO: 5219 - DNA, 27 bp; single-stranded, linear
  The letter "N" represents the stem II region of an HH ribozyme.
uccggaagcugaugangaaaacucuca

SEQ ID NO: 5220 - DNA, 27 bp; single-stranded, linear
  The letter "N" represents the stem II region of an HH ribozyme.
gaguccggcugaugangaaaggaacuc

SEQ ID NO: 5221 - DNA, 27 bp; single-stranded, linear
  The letter "N" represents the stem II region of an HH ribozyme.
agaguccgcugaugangaaaaggaacu

SEQ ID NO: 5222 - DNA, 27 bp; single-stranded, linear
  The letter "N" represents the stem II region of an HH ribozyme.
acacguaacugaugangaaaguccgga

SEQ ID NO: 5223 - DNA, 27 bp; single-stranded, linear
  The letter "N" represents the stem II region of an HH ribozyme.
agacacgucugaugangaaagaguccg

SEQ ID NO: 5224 - DNA, 27 bp; single-stranded, linear
  The letter "N" represents the stem II region of an HH ribozyme.
gagacacgcugaugangaaaagagucc

SEQ ID NO: 5225 - DNA, 27 bp; single-stranded, linear
  The letter "N" represents the stem II region of an HH ribozyme.
ggccaggacugaugangaaacacguaa

SEQ ID NO: 5226 - DNA, 27 bp; single-stranded, linear
  The letter "N" represents the stem II region of an HH ribozyme.
caggccagcugaugangaaagacacgu

SEQ ID NO: 5227 - DNA, 27 bp; single-stranded, linear
  The letter "N" represents the stem II region of an HH ribozyme.
gaaggagccugaugangaaagcugcau

SEQ ID NO: 5228 - DNA, 27 bp; single-stranded, linear
  The letter "N" represents the stem II region of an HH ribozyme.
ugaggaagcugaugangaaagcaagcu

SEQ ID NO: 5229 - DNA, 27 bp; single-stranded, linear
  The letter "N" represents the stem II region of an HH ribozyme.
agaugaggcugaugangaaaggagcaa

SEQ ID NO: 5230 - DNA, 27 bp; single-stranded, linear
  The letter "N" represents the stem II region of an HH ribozyme.
gagaugagcugaugangaaaaggagca

SEQ ID NO: 5231 - DNA, 27 bp; single-stranded, linear
  The letter "N" represents the stem II region of an HH ribozyme.
ugagagaucugaugangaaaggaagga

SEQ ID NO: 5232 - DNA, 27 bp; single-stranded, linear
  The letter "N" represents the stem II region of an HH ribozyme.
gccugagacugaugangaaaugaggaa

SEQ ID NO: 5233 - DNA, 27 bp; single-stranded, linear
  The letter "N" represents the stem II region of an HH ribozyme.
cagccugacugaugangaaagaugagg

SEQ ID NO: 5234 - DNA, 27 bp; single-stranded, linear
  The letter "N" represents the stem II region of an HH ribozyme.
cacagccucugaugangaaagagauga

SEQ ID NO: 5235 - DNA, 27 bp; single-stranded, linear
  The letter "N" represents the stem II region of an HH ribozyme.
ucugaauucugaugangaaaggcacag

SEQ ID NO: 5236 - DNA, 27 bp; single-stranded, linear
  The letter "N" represents the stem II region of an HH ribozyme.
uucugaaucugaugangaaaaggcaca

SEQ ID NO: 5237 - DNA, 27 bp; single-stranded, linear
  The letter "N" represents the stem II region of an HH ribozyme.
guguucugcugaugangaaauuaaggc

SEQ ID NO: 5238 - DNA, 27 bp; single-stranded, linear
  The letter "N" represents the stem II region of an HH ribozyme.
gguguucucugaugangaaaauuaagg

SEQ ID NO: 5239 - DNA, 27 bp; single-stranded, linear
  The letter "N" represents the stem II region of an HH ribozyme.
ccucugcccugaugangaaacguuccu

SEQ ID NO: 5240 - DNA, 27 bp; single-stranded, linear
  The letter "N" represents the stem II region of an HH ribozyme.
cccgucagcugaugangaaagccucug

SEQ ID NO: 5241 - DNA, 27 bp; single-stranded, linear
  The letter "N" represents the stem II region of an HH ribozyme.
guucucaccugaugangaaauucuucg

SEQ ID NO: 5242 - DNA, 27 bp; single-stranded, linear
  The letter "N" represents the stem II region of an HH ribozyme.
gaaacccucugaugangaaaguuucug

SEQ ID NO: 5243 - DNA, 27 bp; single-stranded, linear
  The letter "N" represents the stem II region of an HH ribozyme.
ccagcagacugaugangaaacccugag

SEQ ID NO: 5244 - DNA, 27 bp; single-stranded, linear
  The letter "N" represents the stem II region of an HH ribozyme.
cccagcagcugaugangaaaacccuga

SEQ ID NO: 5245 - DNA, 27 bp; single-stranded, linear
  The letter "N" represents the stem II region of an HH ribozyme.
acccagcacugaugangaaaaacccug

SEQ ID NO: 5246 - DNA, 27 bp; single-stranded, linear
  The letter "N" represents the stem II region of an HH ribozyme.
aacccucacugaugangaaaccugcca

SEQ ID NO: 5247 - DNA, 27 bp; single-stranded, linear
  The letter "N" represents the stem II region of an HH ribozyme.
ugacagagcugaugangaaacccucag

SEQ ID NO: 5248 - DNA, 27 bp; single-stranded, linear
  The letter "N" represents the stem II region of an HH ribozyme.
uugacagacugaugangaaaacccuca

SEQ ID NO: 5249 - DNA, 27 bp; single-stranded, linear
  The letter "N" represents the stem II region of an HH ribozyme.
acuugacacugaugangaaagaacccu

SEQ ID NO: 5250 - DNA, 27 bp; single-stranded, linear
  The letter "N" represents the stem II region of an HH ribozyme.
cgccacuucugaugangaaacagagaa

SEQ ID NO: 5251 - DNA, 27 bp; single-stranded, linear
  The letter "N" represents the stem II region of an HH ribozyme.
ugagccuucugaugangaaaccgccac

SEQ ID NO: 5252 - DNA, 27 bp; single-stranded, linear
  The letter "N" represents the stem II region of an HH ribozyme.
accagccucugaugangaaagccuuua

SEQ ID NO: 5253 - DNA, 27 bp; single-stranded, linear
  The letter "N" represents the stem II region of an HH ribozyme.
agaggaagcugaugangaaacaccagc

SEQ ID NO: 5254 - DNA, 27 bp; single-stranded, linear
  The letter "N" represents the stem II region of an HH ribozyme.
uagaggaacugaugangaaaacaccag

SEQ ID NO: 5255 - DNA, 27 bp; single-stranded, linear
  The letter "N" represents the stem II region of an HH ribozyme.
gauagaggcugaugangaaagaacacc

SEQ ID NO: 5256 - DNA, 27 bp; single-stranded, linear
  The letter "N" represents the stem II region of an HH ribozyme.
agauagagcugaugangaaaagaacac

SEQ ID NO: 5257 - DNA, 27 bp; single-stranded, linear
  The letter "N" represents the stem II region of an HH ribozyme.
uggagauacugaugangaaaggaagaa

SEQ ID NO: 5258 - DNA, 27 bp; single-stranded, linear
  The letter "N" represents the stem II region of an HH ribozyme.
aguggagacugaugangaaagaggaag

SEQ ID NO: 5259 - DNA, 27 bp; single-stranded, linear
  The letter "N" represents the stem II region of an HH ribozyme.
ggaguggacugaugangaaauagagga

SEQ ID NO: 5260 - DNA, 27 bp; single-stranded, linear
  The letter "N" represents the stem II region of an HH ribozyme.
caggagugcugaugangaaagauagag

SEQ ID NO: 5261 - DNA, 27 bp; single-stranded, linear
  The letter "N" represents the stem II region of an HH ribozyme.
ccugacagcugaugangaaaguggaga

SEQ ID NO: 5262 - DNA, 27 bp; single-stranded, linear
  The letter "N" represents the stem II region of an HH ribozyme.
gggggccucugaugangaaacaggagu

SEQ ID NO: 5263 - DNA, 27 bp; single-stranded, linear
  The letter "N" represents the stem II region of an HH ribozyme.
auacugagcugaugangaaacuugggg

SEQ ID NO: 5264 - DNA, 27 bp; single-stranded, linear
  The letter "N" represents the stem II region of an HH ribozyme.
aaaauacucugaugangaaaggacuug

SEQ ID NO: 5265 - DNA, 27 bp; single-stranded, linear
  The letter "N" represents the stem II region of an HH ribozyme.
agcuaaaacugaugangaaacugagga

SEQ ID NO: 5266 - DNA, 27 bp; single-stranded, linear
  The letter "N" represents the stem II region of an HH ribozyme.
aaagcuaacugaugangaaauacugag

SEQ ID NO: 5267 - DNA, 27 bp; single-stranded, linear
  The letter "N" represents the stem II region of an HH ribozyme.
caaagcuacugaugangaaaauacuga

SEQ ID NO: 5268 - DNA, 27 bp; single-stranded, linear
  The letter "N" represents the stem II region of an HH ribozyme.
acaaagcucugaugangaaaaauacug

SEQ ID NO: 5269 - DNA, 27 bp; single-stranded, linear
  The letter "N" represents the stem II region of an HH ribozyme.
cacaaagccugaugangaaaaaauacu

SEQ ID NO: 5270 - DNA, 27 bp; single-stranded, linear
  The letter "N" represents the stem II region of an HH ribozyme.
aagccacacugaugangaaagcuaaaa

SEQ ID NO: 5271 - DNA, 27 bp; single-stranded, linear
  The letter "N" represents the stem II region of an HH ribozyme.
gaagccaccugaugangaaaagcuaaa

SEQ ID NO: 5272 - DNA, 27 bp; single-stranded, linear
  The letter "N" represents the stem II region of an HH ribozyme.
ccaucaggcugaugangaaagccacaa

SEQ ID NO: 5273 - DNA, 27 bp; single-stranded, linear
  The letter "N" represents the stem II region of an HH ribozyme.
gccaucagcugaugangaaaagccaca

SEQ ID NO: 5274 - DNA, 27 bp; single-stranded, linear
  The letter "N" represents the stem II region of an HH ribozyme.
ccaauuaacugaugangaaauuuuucu

SEQ ID NO: 5275 - DNA, 27 bp; single-stranded, linear
  The letter "N" represents the stem II region of an HH ribozyme.
aaccaauucugaugangaaagauuuuu

SEQ ID NO: 5276 - DNA, 27 bp; single-stranded, linear
  The letter "N" represents the stem II region of an HH ribozyme.
caaccaaucugaugangaaaagauuuu

SEQ ID NO: 5277 - DNA, 27 bp; single-stranded, linear
  The letter "N" represents the stem II region of an HH ribozyme.
aaccaacccugaugangaaauuaagau

SEQ ID NO: 5278 - DNA, 27 bp; single-stranded, linear
  The letter "N" represents the stem II region of an HH ribozyme.
agcaaacccugaugangaaaccaauua

SEQ ID NO: 5279 - DNA, 27 bp; single-stranded, linear
  The letter "N" represents the stem II region of an HH ribozyme.
ggagagcacugaugangaaaccaacca

SEQ ID NO: 5280 - DNA, 27 bp; single-stranded, linear
  The letter "N" represents the stem II region of an HH ribozyme.
uggagagccugaugangaaaaccaacc

SEQ ID NO: 5281 - DNA, 27 bp; single-stranded, linear
  The letter "N" represents the stem II region of an HH ribozyme.
uaucuggacugaugangaaagcaaacc

SEQ ID NO: 5282 - DNA, 27 bp; single-stranded, linear
  The letter "N" represents the stem II region of an HH ribozyme.
auuaucugcugaugangaaagagcaaa

SEQ ID NO: 5283 - DNA, 27 bp; single-stranded, linear
  The letter "N" represents the stem II region of an HH ribozyme.
cuagugaucugaugangaaaucuggag

SEQ ID NO: 5284 - DNA, 27 bp; single-stranded, linear
  The letter "N" represents the stem II region of an HH ribozyme.
uggcuagucugaugangaaauuaucug

SEQ ID NO: 5285 - DNA, 27 bp; single-stranded, linear
  The letter "N" represents the stem II region of an HH ribozyme.
aaucuggccugaugangaaagugauua

SEQ ID NO: 5286 - DNA, 27 bp; single-stranded, linear
  The letter "N" represents the stem II region of an HH ribozyme.
aauuucgacugaugangaaaucuggcu

SEQ ID NO: 5287 - DNA, 27 bp; single-stranded, linear
  The letter "N" represents the stem II region of an HH ribozyme.
uaauuucgcugaugangaaaaucuggc

SEQ ID NO: 5288 - DNA, 27 bp; single-stranded, linear
  The letter "N" represents the stem II region of an HH ribozyme.
guaauuuccugaugangaaaaaucugg

SEQ ID NO: 5289 - DNA, 27 bp; single-stranded, linear
  The letter "N" represents the stem II region of an HH ribozyme.
uaaaaagucugaugangaaauuucgaa

SEQ ID NO: 5290 - DNA, 27 bp; single-stranded, linear
  The letter "N" represents the stem II region of an HH ribozyme.
cuaaaaagcugaugangaaaauuucga

SEQ ID NO: 5291 - DNA, 27 bp; single-stranded, linear
  The letter "N" represents the stem II region of an HH ribozyme.
cggcuaaacugaugangaaaguaauuu

SEQ ID NO: 5292 - DNA, 27 bp; single-stranded, linear
  The letter "N" represents the stem II region of an HH ribozyme.
ucggcuaacugaugangaaaaguaauu

SEQ ID NO: 5293 - DNA, 27 bp; single-stranded, linear
  The letter "N" represents the stem II region of an HH ribozyme.
cucggcuacugaugangaaaaaguaau

SEQ ID NO: 5294 - DNA, 27 bp; single-stranded, linear
  The letter "N" represents the stem II region of an HH ribozyme.
ccucggcucugaugangaaaaaaguaa

SEQ ID NO: 5295 - DNA, 27 bp; single-stranded, linear
  The letter "N" represents the stem II region of an HH ribozyme.
accucggccugaugangaaaaaaagua

SEQ ID NO: 5296 - DNA, 27 bp; single-stranded, linear
  The letter "N" represents the stem II region of an HH ribozyme.
guuaucaucugaugangaaaccucggc

SEQ ID NO: 5297 - DNA, 27 bp; single-stranded, linear
  The letter "N" represents the stem II region of an HH ribozyme.
uguuaucacugaugangaaaaccucgg

SEQ ID NO: 5298 - DNA, 27 bp; single-stranded, linear
  The letter "N" represents the stem II region of an HH ribozyme.
guagaugucugaugangaaaucauaac

SEQ ID NO: 5299 - DNA, 27 bp; single-stranded, linear
  The letter "N" represents the stem II region of an HH ribozyme.
auacaguacugaugangaaauguuauc

SEQ ID NO: 5300 - DNA, 27 bp; single-stranded, linear
  The letter "N" represents the stem II region of an HH ribozyme.
ggauacagcugaugangaaagauguua

SEQ ID NO: 5301 - DNA, 27 bp; single-stranded, linear
  The letter "N" represents the stem II region of an HH ribozyme.
cuaaaggacugaugangaaacaguaga

SEQ ID NO: 5302 - DNA, 27 bp; single-stranded, linear
  The letter "N" represents the stem II region of an HH ribozyme.
uucuaaagcugaugangaaauacagua

SEQ ID NO: 5303 - DNA, 27 bp; single-stranded, linear
  The letter "N" represents the stem II region of an HH ribozyme.
aaauucuacugaugangaaaggauaca

SEQ ID NO: 5304 - DNA, 27 bp; single-stranded, linear
  The letter "N" represents the stem II region of an HH ribozyme.
aaaauucucugaugangaaaaggauac

SEQ ID NO: 5305 - DNA, 27 bp; single-stranded, linear
  The letter "N" represents the stem II region of an HH ribozyme.
uaaaauuccugaugangaaaaaggaua

SEQ ID NO: 5306 - DNA, 27 bp; single-stranded, linear
  The letter "N" represents the stem II region of an HH ribozyme.
uagguuaacugaugangaaauucuaaa

SEQ ID NO: 5307 - DNA, 27 bp; single-stranded, linear
  The letter "N" represents the stem II region of an HH ribozyme.
auagguuacugaugangaaaauucuaa

SEQ ID NO: 5308 - DNA, 27 bp; single-stranded, linear
  The letter "N" represents the stem II region of an HH ribozyme.
uauagguucugaugangaaaaauucua

SEQ ID NO: 5309 - DNA, 27 bp; single-stranded, linear
  The letter "N" represents the stem II region of an HH ribozyme.
uuauaggucugaugangaaaaaauucu

SEQ ID NO: 5310 - DNA, 27 bp; single-stranded, linear
  The letter "N" represents the stem II region of an HH ribozyme.
uaguuuuacugaugangaaagguuaaa

SEQ ID NO: 5311 - DNA, 27 bp; single-stranded, linear
  The letter "N" represents the stem II region of an HH ribozyme.
cauaguuucugaugangaaauagguua

SEQ ID NO: 5312 - DNA, 27 bp; single-stranded, linear
  The letter "N" represents the stem II region of an HH ribozyme.
aguagacacugaugangaaaguuuuau

SEQ ID NO: 5313 - DNA, 27 bp; single-stranded, linear
  The letter "N" represents the stem II region of an HH ribozyme.
aaccaguacugaugangaaacauaguu

SEQ ID NO: 5314 - DNA, 27 bp; single-stranded, linear
  The letter "N" represents the stem II region of an HH ribozyme.
gaaaccagcugaugangaaagacauag

SEQ ID NO: 5315 - DNA, 27 bp; single-stranded, linear
  The letter "N" represents the stem II region of an HH ribozyme.
caggcagacugaugangaaaccaguag

SEQ ID NO: 5316 - DNA, 27 bp; single-stranded, linear
  The letter "N" represents the stem II region of an HH ribozyme.
acaggcagcugaugangaaaaccagua

SEQ ID NO: 5317 - DNA, 27 bp; single-stranded, linear
  The letter "N" represents the stem II region of an HH ribozyme.
cacaggcacugaugangaaaaaccagu

SEQ ID NO: 5318 - DNA, 17 bp; single-stranded, linear
gggcgaauuggguacgg

SEQ ID NO: 5319 - DNA, 17 bp; single-stranded, linear
aauuggguacgggaccc

SEQ ID NO: 5320 - DNA, 17 bp; single-stranded, linear
accccccucgaggucga

SEQ ID NO: 5321 - DNA, 17 bp; single-stranded, linear
cucgaggucgacgguau

SEQ ID NO: 5322 - DNA, 17 bp; single-stranded, linear
ucgacgguaucgauaag

SEQ ID NO: 5323 - DNA, 17 bp; single-stranded, linear
gacgguaucgauaagcu

SEQ ID NO: 5324 - DNA, 17 bp; single-stranded, linear
guaucgauaagcuugau

SEQ ID NO: 5325 - DNA, 17 bp; single-stranded, linear
gauaagcuugauaucga

SEQ ID NO: 5326 - DNA, 17 bp; single-stranded, linear
agcuugauaucgaauuc

SEQ ID NO: 5327 - DNA, 17 bp; single-stranded, linear
cuugauaucgaauucgg

SEQ ID NO: 5328 - DNA, 17 bp; single-stranded, linear
uaucgaauucgggccca

SEQ ID NO: 5329 - DNA, 17 bp; single-stranded, linear
aucgaauucgggcccag

SEQ ID NO: 5330 - DNA, 17 bp; single-stranded, linear
gacugugucccgcagcc

SEQ ID NO: 5331 - DNA, 17 bp; single-stranded, linear
gccgggauaaccuggcu

SEQ ID NO: 5332 - DNA, 17 bp; single-stranded, linear
gacccgauuccgcggac

SEQ ID NO: 5333 - DNA, 17 bp; single-stranded, linear
acccgauuccgcggaca

SEQ ID NO: 5334 - DNA, 17 bp; single-stranded, linear
cccgcgcucuccccggu

SEQ ID NO: 5335 - DNA, 17 bp; single-stranded, linear
cgcgcucuccccggucu

SEQ ID NO: 5336 - DNA, 17 bp; single-stranded, linear
uccccggucuugcgcug

SEQ ID NO: 5337 - DNA, 17 bp; single-stranded, linear
cccggucuugcgcugcg

SEQ ID NO: 5338 - DNA, 17 bp; single-stranded, linear
ggggccauaccgccucu

SEQ ID NO: 5339 - DNA, 17 bp; single-stranded, linear
uaccgccucugugacuu

SEQ ID NO: 5340 - DNA, 17 bp; single-stranded, linear
cugugacuucuuugcgg

SEQ ID NO: 5341 - DNA, 17 bp; single-stranded, linear
ugugacuucuuugcggg

SEQ ID NO: 5342 - DNA, 17 bp; single-stranded, linear
ugacuucuuugcgggcc

SEQ ID NO: 5343 - DNA, 17 bp; single-stranded, linear
gacuucuuugcgggcca

SEQ ID NO: 5344 - DNA, 17 bp; single-stranded, linear
gaaggagucugugccug

SEQ ID NO: 5345 - DNA, 17 bp; single-stranded, linear
acugggcucugugccca

SEQ ID NO: 5346 - DNA, 17 bp; single-stranded, linear
gcgcugcuagcugucgc

SEQ ID NO: 5347 - DNA, 17 bp; single-stranded, linear
cuagcugucgcucugug

SEQ ID NO: 5348 - DNA, 17 bp; single-stranded, linear
cugucgcucugugguuc

SEQ ID NO: 5349 - DNA, 17 bp; single-stranded, linear
ucugugguucugcgugg

SEQ ID NO: 5350 - DNA, 17 bp; single-stranded, linear
cugugguucugcgugga

SEQ ID NO: 5351 - DNA, 17 bp; single-stranded, linear
agccgccucuguggguu

SEQ ID NO: 5352 - DNA, 17 bp; single-stranded, linear
cuguggguuugacuggc

SEQ ID NO: 5353 - DNA, 17 bp; single-stranded, linear
uguggguuugacuggcg

SEQ ID NO: 5354 - DNA, 17 bp; single-stranded, linear
cuggcgauuuucuccau

SEQ ID NO: 5355 - DNA, 17 bp; single-stranded, linear
uggcgauuuucuccauc

SEQ ID NO: 5356 - DNA, 17 bp; single-stranded, linear
ggcgauuuucuccaucc

SEQ ID NO: 5357 - DNA, 17 bp; single-stranded, linear
gcgauuuucuccauccc

SEQ ID NO: 5358 - DNA, 17 bp; single-stranded, linear
gauuuucuccauccccc

SEQ ID NO: 5359 - DNA, 17 bp; single-stranded, linear
uucuccauccccccaag

SEQ ID NO: 5360 - DNA, 17 bp; single-stranded, linear
cccaagcucagcacaca

SEQ ID NO: 5361 - DNA, 17 bp; single-stranded, linear
aaagacauacugacaau

SEQ ID NO: 5362 - DNA, 17 bp; single-stranded, linear
cugacaauuuuggcaaa

SEQ ID NO: 5363 - DNA, 17 bp; single-stranded, linear
ugacaauuuuggcaaau

SEQ ID NO: 5364 - DNA, 17 bp; single-stranded, linear
gacaauuuuggcaaaua

SEQ ID NO: 5365 - DNA, 17 bp; single-stranded, linear
uggcaaauacaacccuu

SEQ ID NO: 5366 - DNA, 17 bp; single-stranded, linear
acaacccuucagauuac

SEQ ID NO: 5367 - DNA, 17 bp; single-stranded, linear
caacccuucagauuacu

SEQ ID NO: 5368 - DNA, 17 bp; single-stranded, linear
cuucagauuacuugcag

SEQ ID NO: 5369 - DNA, 17 bp; single-stranded, linear
uucagauuacuugcagg

SEQ ID NO: 5370 - DNA, 17 bp; single-stranded, linear
agauuacuugcagggga

SEQ ID NO: 5371 - DNA, 17 bp; single-stranded, linear
gacuggcuuuggcccaa

SEQ ID NO: 5372 - DNA, 17 bp; single-stranded, linear
acuggcuuuggcccaau

SEQ ID NO: 5373 - DNA, 17 bp; single-stranded, linear
ccaaugcucagcgugau

SEQ ID NO: 5374 - DNA, 17 bp; single-stranded, linear
agcgugauucugaggaa

SEQ ID NO: 5375 - DNA, 17 bp; single-stranded, linear
gcgugauucugaggaaa

SEQ ID NO: 5376 - DNA, 17 bp; single-stranded, linear
gaaaggguauuggugac

SEQ ID NO: 5377 - DNA, 17 bp; single-stranded, linear
aaggguauuggugacug

SEQ ID NO: 5378 - DNA, 17 bp; single-stranded, linear
gugacaguaucuucugc

SEQ ID NO: 5379 - DNA, 17 bp; single-stranded, linear
gacaguaucuucugcaa

SEQ ID NO: 5380 - DNA, 17 bp; single-stranded, linear
caguaucuucugcaaaa

SEQ ID NO: 5381 - DNA, 17 bp; single-stranded, linear
aguaucuucugcaaaac

SEQ ID NO: 5382 - DNA, 17 bp; single-stranded, linear
aaaacacucaccauucc

SEQ ID NO: 5383 - DNA, 17 bp; single-stranded, linear
cucaccauucccagggu

SEQ ID NO: 5384 - DNA, 17 bp; single-stranded, linear
ucaccauucccagggug

SEQ ID NO: 5385 - DNA, 17 bp; single-stranded, linear
agggugguuggaaauga

SEQ ID NO: 5386 - DNA, 17 bp; single-stranded, linear
gaaaugauacuggagcc

SEQ ID NO: 5387 - DNA, 17 bp; single-stranded, linear
uggagccuacaagugcu

SEQ ID NO: 5388 - DNA, 17 bp; single-stranded, linear
caagugcucguaccggg

SEQ ID NO: 5389 - DNA, 17 bp; single-stranded, linear
gugcucguaccgggacg

SEQ ID NO: 5390 - DNA, 17 bp; single-stranded, linear
cgggacgucgacauagc

SEQ ID NO: 5391 - DNA, 17 bp; single-stranded, linear
gucgacauagccuccac

SEQ ID NO: 5392 - DNA, 17 bp; single-stranded, linear
cauagccuccacuguuu

SEQ ID NO: 5393 - DNA, 17 bp; single-stranded, linear
uccacuguuuaugucua

SEQ ID NO: 5394 - DNA, 17 bp; single-stranded, linear
ccacuguuuaugucuau

SEQ ID NO: 5395 - DNA, 17 bp; single-stranded, linear
cacuguuuaugucuaug

SEQ ID NO: 5396 - DNA, 17 bp; single-stranded, linear
guuuaugucuauguucg

SEQ ID NO: 5397 - DNA, 17 bp; single-stranded, linear
uuaugucuauguucgag

SEQ ID NO: 5398 - DNA, 17 bp; single-stranded, linear
gucuauguucgagauua

SEQ ID NO: 5399 - DNA, 17 bp; single-stranded, linear
ucuauguucgagauuac

SEQ ID NO: 5400 - DNA, 17 bp; single-stranded, linear
uucgagauuacagauca

SEQ ID NO: 5401 - DNA, 17 bp; single-stranded, linear
ucgagauuacagaucac

SEQ ID NO: 5402 - DNA, 17 bp; single-stranded, linear
uuacagaucaccauuca

SEQ ID NO: 5403 - DNA, 17 bp; single-stranded, linear
aucaccauucaucgccu

SEQ ID NO: 5404 - DNA, 17 bp; single-stranded, linear
ucaccauucaucgccuc

SEQ ID NO: 5405 - DNA, 17 bp; single-stranded, linear
ccauucaucgccucugu

SEQ ID NO: 5406 - DNA, 17 bp; single-stranded, linear
caucgccucugucagug

SEQ ID NO: 5407 - DNA, 17 bp; single-stranded, linear
gccucugucagugacca

SEQ ID NO: 5408 - DNA, 17 bp; single-stranded, linear
cauggcaucguguacau

SEQ ID NO: 5409 - DNA, 17 bp; single-stranded, linear
caucguguacaucaccg

SEQ ID NO: 5410 - DNA, 17 bp; single-stranded, linear
guguacaucaccgagaa

SEQ ID NO: 5411 - DNA, 17 bp; single-stranded, linear
guggugauccccugccg

SEQ ID NO: 5412 - DNA, 17 bp; single-stranded, linear
ccgagggucgauuucaa

SEQ ID NO: 5413 - DNA, 17 bp; single-stranded, linear
gggucgauuucaaaccu

SEQ ID NO: 5414 - DNA, 17 bp; single-stranded, linear
ggucgauuucaaaccuc

SEQ ID NO: 5415 - DNA, 17 bp; single-stranded, linear
gucgauuucaaaccuca

SEQ ID NO: 5416 - DNA, 17 bp; single-stranded, linear
ucaaaccucaauguguc

SEQ ID NO: 5417 - DNA, 17 bp; single-stranded, linear
caaugugucucuuugcg

SEQ ID NO: 5418 - DNA, 17 bp; single-stranded, linear
augugucucuuugcgcu

SEQ ID NO: 5419 - DNA, 17 bp; single-stranded, linear
gugucucuuugcgcuag

SEQ ID NO: 5420 - DNA, 17 bp; single-stranded, linear
ugucucuuugcgcuagg

SEQ ID NO: 5421 - DNA, 17 bp; single-stranded, linear
uuugcgcuagguaucca

SEQ ID NO: 5422 - DNA, 17 bp; single-stranded, linear
cgcuagguauccagaaa

SEQ ID NO: 5423 - DNA, 17 bp; single-stranded, linear
cuagguauccagaaaag

SEQ ID NO: 5424 - DNA, 17 bp; single-stranded, linear
aaagagauuuguuccgg

SEQ ID NO: 5425 - DNA, 17 bp; single-stranded, linear
aagagauuuguuccgga

SEQ ID NO: 5426 - DNA, 17 bp; single-stranded, linear
agauuuguuccggaugg

SEQ ID NO: 5427 - DNA, 17 bp; single-stranded, linear
gauuuguuccggaugga

SEQ ID NO: 5428 - DNA, 17 bp; single-stranded, linear
aacagaauuuccuggga

SEQ ID NO: 5429 - DNA, 17 bp; single-stranded, linear
acagaauuuccugggac

SEQ ID NO: 5430 - DNA, 17 bp; single-stranded, linear
cagaauuuccugggaca

SEQ ID NO: 5431 - DNA, 17 bp; single-stranded, linear
agcgagauaggcuuuac

SEQ ID NO: 5432 - DNA, 17 bp; single-stranded, linear
gauaggcuuuacucucc

SEQ ID NO: 5433 - DNA, 17 bp; single-stranded, linear
auaggcuuuacucuccc

SEQ ID NO: 5434 - DNA, 17 bp; single-stranded, linear
uaggcuuuacucucccc

SEQ ID NO: 5435 - DNA, 17 bp; single-stranded, linear
gcuuuacucuccccagu

SEQ ID NO: 5436 - DNA, 17 bp; single-stranded, linear
uuuacucuccccaguua

SEQ ID NO: 5437 - DNA, 17 bp; single-stranded, linear
uccccaguuacaugauc

SEQ ID NO: 5438 - DNA, 17 bp; single-stranded, linear
ccccaguuacaugauca

SEQ ID NO: 5439 - DNA, 17 bp; single-stranded, linear
uacaugaucagcuaugc

SEQ ID NO: 5440 - DNA, 17 bp; single-stranded, linear
gaucagcuaugccggca

SEQ ID NO: 5441 - DNA, 17 bp; single-stranded, linear
ggcauggucuucuguga

SEQ ID NO: 5442 - DNA, 17 bp; single-stranded, linear
cauggucuucugugagg

SEQ ID NO: 5443 - DNA, 17 bp; single-stranded, linear
auggucuucugugaggc

SEQ ID NO: 5444 - DNA, 17 bp; single-stranded, linear
gcaaagaucaaugauga

SEQ ID NO: 5445 - DNA, 17 bp; single-stranded, linear
ugaaaccuaucagucua

SEQ ID NO: 5446 - DNA, 17 bp; single-stranded, linear
aaaccuaucagucuauc

SEQ ID NO: 5447 - DNA, 17 bp; single-stranded, linear
cuaucagucuaucaugu

SEQ ID NO: 5448 - DNA, 17 bp; single-stranded, linear
aucagucuaucauguac

SEQ ID NO: 5449 - DNA, 17 bp; single-stranded, linear
cagucuaucauguacau

SEQ ID NO: 5450 - DNA, 17 bp; single-stranded, linear
uaucauguacauaguug

SEQ ID NO: 5451 - DNA, 17 bp; single-stranded, linear
auguacauaguuguggu

SEQ ID NO: 5452 - DNA, 17 bp; single-stranded, linear
uacauaguugugguugu

SEQ ID NO: 5453 - DNA, 17 bp; single-stranded, linear
guugugguuguaggaua

SEQ ID NO: 5454 - DNA, 17 bp; single-stranded, linear
gugguuguaggauauag

SEQ ID NO: 5455 - DNA, 17 bp; single-stranded, linear
uguaggauauaggauuu

SEQ ID NO: 5456 - DNA, 17 bp; single-stranded, linear
uaggauauaggauuuau

SEQ ID NO: 5457 - DNA, 17 bp; single-stranded, linear
uauaggauuuaugaugu

SEQ ID NO: 5458 - DNA, 17 bp; single-stranded, linear
auaggauuuaugaugug

SEQ ID NO: 5459 - DNA, 17 bp; single-stranded, linear
uaggauuuaugauguga

SEQ ID NO: 5460 - DNA, 17 bp; single-stranded, linear
gaugugauucugagccc

SEQ ID NO: 5461 - DNA, 17 bp; single-stranded, linear
augugauucugagcccc

SEQ ID NO: 5462 - DNA, 17 bp; single-stranded, linear
caugaaauugagcuauc

SEQ ID NO: 5463 - DNA, 17 bp; single-stranded, linear
auugagcuaucugccgg

SEQ ID NO: 5464 - DNA, 17 bp; single-stranded, linear
ugagcuaucugccggag

SEQ ID NO: 5465 - DNA, 17 bp; single-stranded, linear
gaaaaacuugucuuaaa

SEQ ID NO: 5466 - DNA, 17 bp; single-stranded, linear
aaacuugucuuaaauug

SEQ ID NO: 5467 - DNA, 17 bp; single-stranded, linear
acuugucuuaaauugua

SEQ ID NO: 5468 - DNA, 17 bp; single-stranded, linear
cuugucuuaaauuguac

SEQ ID NO: 5469 - DNA, 17 bp; single-stranded, linear
ucuuaaauuguacagcg

SEQ ID NO: 5470 - DNA, 17 bp; single-stranded, linear
uaaauuguacagcgaga

SEQ ID NO: 5471 - DNA, 17 bp; single-stranded, linear
acagagcucaauguggg

SEQ ID NO: 5472 - DNA, 17 bp; single-stranded, linear
guggggcuugauuucac

SEQ ID NO: 5473 - DNA, 17 bp; single-stranded, linear
ggcuugauuucaccugg

SEQ ID NO: 5474 - DNA, 17 bp; single-stranded, linear
gcuugauuucaccuggc

SEQ ID NO: 5475 - DNA, 17 bp; single-stranded, linear
cuugauuucaccuggca

SEQ ID NO: 5476 - DNA, 17 bp; single-stranded, linear
cuggcacucuccaccuu

SEQ ID NO: 5477 - DNA, 17 bp; single-stranded, linear
ggcacucuccaccuuca

SEQ ID NO: 5478 - DNA, 17 bp; single-stranded, linear
cuccaccuucaaagucu

SEQ ID NO: 5479 - DNA, 17 bp; single-stranded, linear
uccaccuucaaagucuc

SEQ ID NO: 5480 - DNA, 17 bp; single-stranded, linear
uucaaagucucaucaua

SEQ ID NO: 5481 - DNA, 17 bp; single-stranded, linear
caaagucucaucauaag

SEQ ID NO: 5482 - DNA, 17 bp; single-stranded, linear
agucucaucauaagaag

SEQ ID NO: 5483 - DNA, 17 bp; single-stranded, linear
cucaucauaagaagauu

SEQ ID NO: 5484 - DNA, 17 bp; single-stranded, linear
aagaagauuguaaaccg

SEQ ID NO: 5485 - DNA, 17 bp; single-stranded, linear
aagauuguaaaccggga

SEQ ID NO: 5486 - DNA, 17 bp; single-stranded, linear
gaaacccuuuccuggga

SEQ ID NO: 5487 - DNA, 17 bp; single-stranded, linear
aaacccuuuccugggac

SEQ ID NO: 5488 - DNA, 17 bp; single-stranded, linear
aacccuuuccugggacu

SEQ ID NO: 5489 - DNA, 17 bp; single-stranded, linear
gaagauguuuuugagca

SEQ ID NO: 5490 - DNA, 17 bp; single-stranded, linear
aagauguuuuugagcac

SEQ ID NO: 5491 - DNA, 17 bp; single-stranded, linear
agauguuuuugagcacc

SEQ ID NO: 5492 - DNA, 17 bp; single-stranded, linear
gauguuuuugagcaccu

SEQ ID NO: 5493 - DNA, 17 bp; single-stranded, linear
gagcaccuugacaauag

SEQ ID NO: 5494 - DNA, 17 bp; single-stranded, linear
uugacaauagaaagugu

SEQ ID NO: 5495 - DNA, 17 bp; single-stranded, linear
aggggaauacaccugug

SEQ ID NO: 5496 - DNA, 17 bp; single-stranded, linear
accuguguagcguccag

SEQ ID NO: 5497 - DNA, 17 bp; single-stranded, linear
uguagcguccaguggac

SEQ ID NO: 5498 - DNA, 17 bp; single-stranded, linear
cggaugaucaagagaaa

SEQ ID NO: 5499 - DNA, 17 bp; single-stranded, linear
agagaaauagaacauuu

SEQ ID NO: 5500 - DNA, 17 bp; single-stranded, linear
uagaacauuuguccgag

SEQ ID NO: 5501 - DNA, 17 bp; single-stranded, linear
agaacauuuguccgagu

SEQ ID NO: 5502 - DNA, 17 bp; single-stranded, linear
acauuuguccgaguuca

SEQ ID NO: 5503 - DNA, 17 bp; single-stranded, linear
guccgaguucacacaaa

SEQ ID NO: 5504 - DNA, 17 bp; single-stranded, linear
uccgaguucacacaaag

SEQ ID NO: 5505 - DNA, 17 bp; single-stranded, linear
caaagccuuuuauugcu

SEQ ID NO: 5506 - DNA, 17 bp; single-stranded, linear
aaagccuuuuauugcuu

SEQ ID NO: 5507 - DNA, 17 bp; single-stranded, linear
aagccuuuuauugcuuu

SEQ ID NO: 5508 - DNA, 17 bp; single-stranded, linear
agccuuuuauugcuuuc

SEQ ID NO: 5509 - DNA, 17 bp; single-stranded, linear
ccuuuuauugcuuucgg

SEQ ID NO: 5510 - DNA, 17 bp; single-stranded, linear
uuauugcuuucgguagu

SEQ ID NO: 5511 - DNA, 17 bp; single-stranded, linear
uauugcuuucgguagug

SEQ ID NO: 5512 - DNA, 17 bp; single-stranded, linear
auugcuuucgguagugg

SEQ ID NO: 5513 - DNA, 17 bp; single-stranded, linear
cuuucgguagugggaug

SEQ ID NO: 5514 - DNA, 17 bp; single-stranded, linear
gaugaaaucuuuggugg

SEQ ID NO: 5515 - DNA, 17 bp; single-stranded, linear
ugaaaucuuugguggaa

SEQ ID NO: 5516 - DNA, 17 bp; single-stranded, linear
gaaaucuuugguggaag

SEQ ID NO: 5517 - DNA, 17 bp; single-stranded, linear
ugggcagucaaguccga

SEQ ID NO: 5518 - DNA, 17 bp; single-stranded, linear
agucaaguccgaauccc

SEQ ID NO: 5519 - DNA, 17 bp; single-stranded, linear
guccgaaucccugugaa

SEQ ID NO: 5520 - DNA, 17 bp; single-stranded, linear
ugugaaguaucucaguu

SEQ ID NO: 5521 - DNA, 17 bp; single-stranded, linear
ugaaguaucucaguuac

SEQ ID NO: 5522 - DNA, 17 bp; single-stranded, linear
aaguaucucaguuaccc

SEQ ID NO: 5523 - DNA, 17 bp; single-stranded, linear
aucucaguuacccagcu

SEQ ID NO: 5524 - DNA, 17 bp; single-stranded, linear
ucucaguuacccagcuc

SEQ ID NO: 5525 - DNA, 17 bp; single-stranded, linear
acccagcuccugauauc

SEQ ID NO: 5526 - DNA, 17 bp; single-stranded, linear
cuccugauaucaaaugg

SEQ ID NO: 5527 - DNA, 17 bp; single-stranded, linear
ccugauaucaaauggua

SEQ ID NO: 5528 - DNA, 17 bp; single-stranded, linear
caaaugguacagaaaug

SEQ ID NO: 5529 - DNA, 17 bp; single-stranded, linear
aggcccauugaguccaa

SEQ ID NO: 5530 - DNA, 17 bp; single-stranded, linear
cauugaguccaacuaca

SEQ ID NO: 5531 - DNA, 17 bp; single-stranded, linear
guccaacuacacaauga

SEQ ID NO: 5532 - DNA, 17 bp; single-stranded, linear
acaaugauuguuggcga

SEQ ID NO: 5533 - DNA, 17 bp; single-stranded, linear
augauuguuggcgauga

SEQ ID NO: 5534 - DNA, 17 bp; single-stranded, linear
gaugaacucaccaucau

SEQ ID NO: 5535 - DNA, 17 bp; single-stranded, linear
cucaccaucauggaagu

SEQ ID NO: 5536 - DNA, 17 bp; single-stranded, linear
aggaaacuacacgguca

SEQ ID NO: 5537 - DNA, 17 bp; single-stranded, linear
uacacggucauccucac

SEQ ID NO: 5538 - DNA, 17 bp; single-stranded, linear
acggucauccucaccaa

SEQ ID NO: 5539 - DNA, 17 bp; single-stranded, linear
gucauccucaccaaccc

SEQ ID NO: 5540 - DNA, 17 bp; single-stranded, linear
aaccccauuucaaugga

SEQ ID NO: 5541 - DNA, 17 bp; single-stranded, linear
accccauuucaauggag

SEQ ID NO: 5542 - DNA, 17 bp; single-stranded, linear
ccccauuucaauggaga

SEQ ID NO: 5543 - DNA, 17 bp; single-stranded, linear
cacauggucucucuggu

SEQ ID NO: 5544 - DNA, 17 bp; single-stranded, linear
cauggucucucugguug

SEQ ID NO: 5545 - DNA, 17 bp; single-stranded, linear
uggucucucugguugug

SEQ ID NO: 5546 - DNA, 17 bp; single-stranded, linear
ucucugguugugaaugu

SEQ ID NO: 5547 - DNA, 17 bp; single-stranded, linear
gugaaugucccacccca

SEQ ID NO: 5548 - DNA, 17 bp; single-stranded, linear
ccccagaucggugagaa

SEQ ID NO: 5549 - DNA, 17 bp; single-stranded, linear
gaaagccuugaucucgc

SEQ ID NO: 5550 - DNA, 17 bp; single-stranded, linear
gccuugaucucgccuau

SEQ ID NO: 5551 - DNA, 17 bp; single-stranded, linear
cuugaucucgccuaugg

SEQ ID NO: 5552 - DNA, 17 bp; single-stranded, linear
ucucgccuauggauucc

SEQ ID NO: 5553 - DNA, 17 bp; single-stranded, linear
cuauggauuccuaccag

SEQ ID NO: 5554 - DNA, 17 bp; single-stranded, linear
uauggauuccuaccagu

SEQ ID NO: 5555 - DNA, 17 bp; single-stranded, linear
ggauuccuaccaguaug

SEQ ID NO: 5556 - DNA, 17 bp; single-stranded, linear
cuaccaguaugggacca

SEQ ID NO: 5557 - DNA, 17 bp; single-stranded, linear
gcagacauugacaugca

SEQ ID NO: 5558 - DNA, 17 bp; single-stranded, linear
ugcacagucuacgccaa

SEQ ID NO: 5559 - DNA, 17 bp; single-stranded, linear
cacagucuacgccaacc

SEQ ID NO: 5560 - DNA, 17 bp; single-stranded, linear
ccaacccuccccugcac

SEQ ID NO: 5561 - DNA, 17 bp; single-stranded, linear
caccacauccaguggua

SEQ ID NO: 5562 - DNA, 17 bp; single-stranded, linear
ccagugguacuggcagc

SEQ ID NO: 5563 - DNA, 17 bp; single-stranded, linear
uggcagcuagaagaagc

SEQ ID NO: 5564 - DNA, 17 bp; single-stranded, linear
agccugcuccuacagac

SEQ ID NO: 5565 - DNA, 17 bp; single-stranded, linear
cugcuccuacagacccg

SEQ ID NO: 5566 - DNA, 17 bp; single-stranded, linear
aagcccguaugcuugua

SEQ ID NO: 5567 - DNA, 17 bp; single-stranded, linear
cguaugcuuguaaagaa

SEQ ID NO: 5568 - DNA, 17 bp; single-stranded, linear
augcuuguaaagaaugg

SEQ ID NO: 5569 - DNA, 17 bp; single-stranded, linear
uggaggauuuccagggg

SEQ ID NO: 5570 - DNA, 17 bp; single-stranded, linear
ggaggauuuccaggggg

SEQ ID NO: 5571 - DNA, 17 bp; single-stranded, linear
gaggauuuccagggggg

SEQ ID NO: 5572 - DNA, 17 bp; single-stranded, linear
aacaagaucgaagucac

SEQ ID NO: 5573 - DNA, 17 bp; single-stranded, linear
aucgaagucaccaaaaa

SEQ ID NO: 5574 - DNA, 17 bp; single-stranded, linear
aaaccaauaugcccuga

SEQ ID NO: 5575 - DNA, 17 bp; single-stranded, linear
gcccugauugaaggaaa

SEQ ID NO: 5576 - DNA, 17 bp; single-stranded, linear
aaaacuguaaguacgcu

SEQ ID NO: 5577 - DNA, 17 bp; single-stranded, linear
cuguaaguacgcugguc

SEQ ID NO: 5578 - DNA, 17 bp; single-stranded, linear
acgcuggucauccaagc

SEQ ID NO: 5579 - DNA, 17 bp; single-stranded, linear
cuggucauccaagcugc

SEQ ID NO: 5580 - DNA, 17 bp; single-stranded, linear
caacgugucagcguugu

SEQ ID NO: 5581 - DNA, 17 bp; single-stranded, linear
gucagcguuguacaaau

SEQ ID NO: 5582 - DNA, 17 bp; single-stranded, linear
agcguuguacaaaugug

SEQ ID NO: 5583 - DNA, 17 bp; single-stranded, linear
gaagccaucaacaaagc

SEQ ID NO: 5584 - DNA, 17 bp; single-stranded, linear
gagagggucaucuccuu

SEQ ID NO: 5585 - DNA, 17 bp; single-stranded, linear
agggucaucuccuucca

SEQ ID NO: 5586 - DNA, 17 bp; single-stranded, linear
ggucaucuccuuccaug

SEQ ID NO: 5587 - DNA, 17 bp; single-stranded, linear
caucuccuuccauguga

SEQ ID NO: 5588 - DNA, 17 bp; single-stranded, linear
aucuccuuccaugugau

SEQ ID NO: 5589 - DNA, 17 bp; single-stranded, linear
caugugaucaggggucc

SEQ ID NO: 5590 - DNA, 17 bp; single-stranded, linear
ucagggguccugaaauu

SEQ ID NO: 5591 - DNA, 17 bp; single-stranded, linear
ccugaaauuacugugca

SEQ ID NO: 5592 - DNA, 17 bp; single-stranded, linear
cugaaauuacugugcaa

SEQ ID NO: 5593 - DNA, 17 bp; single-stranded, linear
gagugugucccuguugu

SEQ ID NO: 5594 - DNA, 17 bp; single-stranded, linear
gucccuguugugcacug

SEQ ID NO: 5595 - DNA, 17 bp; single-stranded, linear
acagaaauacguuugag

SEQ ID NO: 5596 - DNA, 17 bp; single-stranded, linear
aaauacguuugagaacc

SEQ ID NO: 5597 - DNA, 17 bp; single-stranded, linear
aauacguuugagaaccu

SEQ ID NO: 5598 - DNA, 17 bp; single-stranded, linear
gagaaccucacguggua

SEQ ID NO: 5599 - DNA, 17 bp; single-stranded, linear
cacgugguacaagcuug

SEQ ID NO: 5600 - DNA, 17 bp; single-stranded, linear
uacaagcuuggcucaca

SEQ ID NO: 5601 - DNA, 17 bp; single-stranded, linear
gcuuggcucacaggcaa

SEQ ID NO: 5602 - DNA, 17 bp; single-stranded, linear
ggcaacaucgguccaca

SEQ ID NO: 5603 - DNA, 17 bp; single-stranded, linear
acaucgguccacauggg

SEQ ID NO: 5604 - DNA, 17 bp; single-stranded, linear
gggcgaaucacucacac

SEQ ID NO: 5605 - DNA, 17 bp; single-stranded, linear
gaaucacucacaccagu

SEQ ID NO: 5606 - DNA, 17 bp; single-stranded, linear
acaccaguuugcaagaa

SEQ ID NO: 5607 - DNA, 17 bp; single-stranded, linear
caccaguuugcaagaac

SEQ ID NO: 5608 - DNA, 17 bp; single-stranded, linear
caagaacuuggaugcuc

SEQ ID NO: 5609 - DNA, 17 bp; single-stranded, linear
uggaugcucuuuggaaa

SEQ ID NO: 5610 - DNA, 17 bp; single-stranded, linear
gaugcucuuuggaaacu

SEQ ID NO: 5611 - DNA, 17 bp; single-stranded, linear
augcucuuuggaaacug

SEQ ID NO: 5612 - DNA, 17 bp; single-stranded, linear
caccauguuuucuaaca

SEQ ID NO: 5613 - DNA, 17 bp; single-stranded, linear
accauguuuucuaacag

SEQ ID NO: 5614 - DNA, 17 bp; single-stranded, linear
ccauguuuucuaacagc

SEQ ID NO: 5615 - DNA, 17 bp; single-stranded, linear
cauguuuucuaacagca

SEQ ID NO: 5616 - DNA, 17 bp; single-stranded, linear
uguuuucuaacagcaca

SEQ ID NO: 5617 - DNA, 17 bp; single-stranded, linear
aaugacaucuugauugu

SEQ ID NO: 5618 - DNA, 17 bp; single-stranded, linear
ugacaucuugauugugg

SEQ ID NO: 5619 - DNA, 17 bp; single-stranded, linear
aucuugauuguggcauu

SEQ ID NO: 5620 - DNA, 17 bp; single-stranded, linear
uguggcauuucagaaug

SEQ ID NO: 5621 - DNA, 17 bp; single-stranded, linear
guggcauuucagaaugc

SEQ ID NO: 5622 - DNA, 17 bp; single-stranded, linear
uggcauuucagaaugcc

SEQ ID NO: 5623 - DNA, 17 bp; single-stranded, linear
gaaugccucucugcagg

SEQ ID NO: 5624 - DNA, 17 bp; single-stranded, linear
augccucucugcaggac

SEQ ID NO: 5625 - DNA, 17 bp; single-stranded, linear
aggcgacuauguuugcu

SEQ ID NO: 5626 - DNA, 17 bp; single-stranded, linear
gacuauguuugcucugc

SEQ ID NO: 5627 - DNA, 17 bp; single-stranded, linear
acuauguuugcucugcu

SEQ ID NO: 5628 - DNA, 17 bp; single-stranded, linear
uguuugcucugcucaag

SEQ ID NO: 5629 - DNA, 17 bp; single-stranded, linear
gcucugcucaagauaag

SEQ ID NO: 5630 - DNA, 17 bp; single-stranded, linear
cucaagauaagaagacc

SEQ ID NO: 5631 - DNA, 17 bp; single-stranded, linear
aaagacauugccugguc

SEQ ID NO: 5632 - DNA, 17 bp; single-stranded, linear
ugccuggucaaacagcu

SEQ ID NO: 5633 - DNA, 17 bp; single-stranded, linear
aaacagcucaucauccu

SEQ ID NO: 5634 - DNA, 17 bp; single-stranded, linear
cagcucaucauccuaga

SEQ ID NO: 5635 - DNA, 17 bp; single-stranded, linear
cucaucauccuagagcg

SEQ ID NO: 5636 - DNA, 17 bp; single-stranded, linear
aucauccuagagcgcau

SEQ ID NO: 5637 - DNA, 17 bp; single-stranded, linear
cccaugaucaccggaaa

SEQ ID NO: 5638 - DNA, 17 bp; single-stranded, linear
ccggaaaucuggagaau

SEQ ID NO: 5639 - DNA, 17 bp; single-stranded, linear
uggagaaucagacaaca

SEQ ID NO: 5640 - DNA, 17 bp; single-stranded, linear
acaaccauuggcgagac

SEQ ID NO: 5641 - DNA, 17 bp; single-stranded, linear
gagaccauugaagugac

SEQ ID NO: 5642 - DNA, 17 bp; single-stranded, linear
aagugacuugcccagca

SEQ ID NO: 5643 - DNA, 17 bp; single-stranded, linear
cccagcaucuggaaauc

SEQ ID NO: 5644 - DNA, 17 bp; single-stranded, linear
cuggaaauccuacccca

SEQ ID NO: 5645 - DNA, 17 bp; single-stranded, linear
gaaauccuaccccacac

SEQ ID NO: 5646 - DNA, 17 bp; single-stranded, linear
ccacacauuacaugguu

SEQ ID NO: 5647 - DNA, 17 bp; single-stranded, linear
cacacauuacaugguuc

SEQ ID NO: 5648 - DNA, 17 bp; single-stranded, linear
uacaugguucaaagaca

SEQ ID NO: 5649 - DNA, 17 bp; single-stranded, linear
acaugguucaaagacaa

SEQ ID NO: 5650 - DNA, 17 bp; single-stranded, linear
acccugguagaagauuc

SEQ ID NO: 5651 - DNA, 17 bp; single-stranded, linear
uagaagauucaggcauu

SEQ ID NO: 5652 - DNA, 17 bp; single-stranded, linear
agaagauucaggcauug

SEQ ID NO: 5653 - DNA, 17 bp; single-stranded, linear
ucaggcauuguacugag

SEQ ID NO: 5654 - DNA, 17 bp; single-stranded, linear
ggcauuguacugagaga

SEQ ID NO: 5655 - DNA, 17 bp; single-stranded, linear
accugacuauccgcagg

SEQ ID NO: 5656 - DNA, 17 bp; single-stranded, linear
cugacuauccgcagggu

SEQ ID NO: 5657 - DNA, 17 bp; single-stranded, linear
ggaggccucuacaccug

SEQ ID NO: 5658 - DNA, 17 bp; single-stranded, linear
aggccucuacaccugcc

SEQ ID NO: 5659 - DNA, 17 bp; single-stranded, linear
ugcaauguccuuggcug

SEQ ID NO: 5660 - DNA, 17 bp; single-stranded, linear
aauguccuuggcugugc

SEQ ID NO: 5661 - DNA, 17 bp; single-stranded, linear
gagacgcucuucauaau

SEQ ID NO: 5662 - DNA, 17 bp; single-stranded, linear
gacgcucuucauaauag

SEQ ID NO: 5663 - DNA, 17 bp; single-stranded, linear
acgcucuucauaauaga

SEQ ID NO: 5664 - DNA, 17 bp; single-stranded, linear
cucuucauaauagaagg

SEQ ID NO: 5665 - DNA, 17 bp; single-stranded, linear
uucauaauagaaggugc

SEQ ID NO: 5666 - DNA, 17 bp; single-stranded, linear
gaccaacuuggaaguca

SEQ ID NO: 5667 - DNA, 17 bp; single-stranded, linear
uuggaagucauuauccu

SEQ ID NO: 5668 - DNA, 17 bp; single-stranded, linear
gaagucauuauccucgu

SEQ ID NO: 5669 - DNA, 17 bp; single-stranded, linear
aagucauuauccucguc

SEQ ID NO: 5670 - DNA, 17 bp; single-stranded, linear
gucauuauccucgucgg

SEQ ID NO: 5671 - DNA, 17 bp; single-stranded, linear
auuauccucgucggcac

SEQ ID NO: 5672 - DNA, 17 bp; single-stranded, linear
auccucgucggcacugc

SEQ ID NO: 5673 - DNA, 17 bp; single-stranded, linear
gcagugauugccauguu

SEQ ID NO: 5674 - DNA, 17 bp; single-stranded, linear
ugccauguucuucuggc

SEQ ID NO: 5675 - DNA, 17 bp; single-stranded, linear
gccauguucuucuggcu

SEQ ID NO: 5676 - DNA, 17 bp; single-stranded, linear
cauguucuucuggcucc

SEQ ID NO: 5677 - DNA, 17 bp; single-stranded, linear
auguucuucuggcuccu

SEQ ID NO: 5678 - DNA, 17 bp; single-stranded, linear
uucuggcuccuucuugu

SEQ ID NO: 5679 - DNA, 17 bp; single-stranded, linear
uggcuccuucuugucau

SEQ ID NO: 5680 - DNA, 17 bp; single-stranded, linear
ggcuccuucuugucauu

SEQ ID NO: 5681 - DNA, 17 bp; single-stranded, linear
cuccuucuugucauugu

SEQ ID NO: 5682 - DNA, 17 bp; single-stranded, linear
cuucuugucauuguccu

SEQ ID NO: 5683 - DNA, 17 bp; single-stranded, linear
cuugucauuguccuacg

SEQ ID NO: 5684 - DNA, 17 bp; single-stranded, linear
gucauuguccuacggac

SEQ ID NO: 5685 - DNA, 17 bp; single-stranded, linear
auuguccuacggaccgu

SEQ ID NO: 5686 - DNA, 17 bp; single-stranded, linear
cggaccguuaagcgggc

SEQ ID NO: 5687 - DNA, 17 bp; single-stranded, linear
ggaccguuaagcgggcc

SEQ ID NO: 5688 - DNA, 17 bp; single-stranded, linear
gacaggcuacuugucua

SEQ ID NO: 5689 - DNA, 17 bp; single-stranded, linear
aggcuacuugucuauug

SEQ ID NO: 5690 - DNA, 17 bp; single-stranded, linear
cuacuugucuauuguca

SEQ ID NO: 5691 - DNA, 17 bp; single-stranded, linear
acuugucuauugucaug

SEQ ID NO: 5692 - DNA, 17 bp; single-stranded, linear
uugucuauugucaugga

SEQ ID NO: 5693 - DNA, 17 bp; single-stranded, linear
ucuauugucauggaucc

SEQ ID NO: 5694 - DNA, 17 bp; single-stranded, linear
ucauggauccagaugaa

SEQ ID NO: 5695 - DNA, 17 bp; single-stranded, linear
agaugaauugcccuugg

SEQ ID NO: 5696 - DNA, 17 bp; single-stranded, linear
auugcccuuggaugagc

SEQ ID NO: 5697 - DNA, 17 bp; single-stranded, linear
ugaacgcuugccuuaug

SEQ ID NO: 5698 - DNA, 17 bp; single-stranded, linear
gcuugccuuaugaugcc

SEQ ID NO: 5699 - DNA, 17 bp; single-stranded, linear
cuugccuuaugaugcca

SEQ ID NO: 5700 - DNA, 17 bp; single-stranded, linear
gugggaauuccccaggg

SEQ ID NO: 5701 - DNA, 17 bp; single-stranded, linear
ugggaauuccccaggga

SEQ ID NO: 5702 - DNA, 17 bp; single-stranded, linear
cugaaacuaggaaaacc

SEQ ID NO: 5703 - DNA, 17 bp; single-stranded, linear
gaaaaccucuuggccgc

SEQ ID NO: 5704 - DNA, 17 bp; single-stranded, linear
aaaccucuuggccgcgg

SEQ ID NO: 5705 - DNA, 17 bp; single-stranded, linear
cggugccuucggccaag

SEQ ID NO: 5706 - DNA, 17 bp; single-stranded, linear
ggugccuucggccaagu

SEQ ID NO: 5707 - DNA, 17 bp; single-stranded, linear
caagugauugaggcaga

SEQ ID NO: 5708 - DNA, 17 bp; single-stranded, linear
cagacgcuuuuggaauu

SEQ ID NO: 5709 - DNA, 17 bp; single-stranded, linear
agacgcuuuuggaauug

SEQ ID NO: 5710 - DNA, 17 bp; single-stranded, linear
gacgcuuuuggaauuga

SEQ ID NO: 5711 - DNA, 17 bp; single-stranded, linear
uuuggaauugacaagac

SEQ ID NO: 5712 - DNA, 17 bp; single-stranded, linear
cagcgacuugcaaaaca

SEQ ID NO: 5713 - DNA, 17 bp; single-stranded, linear
aaaacaguagccgucaa

SEQ ID NO: 5714 - DNA, 17 bp; single-stranded, linear
guagccgucaagauguu

SEQ ID NO: 5715 - DNA, 17 bp; single-stranded, linear
caagauguugaaagaag

SEQ ID NO: 5716 - DNA, 17 bp; single-stranded, linear
gcgagcaucgagcccuc

SEQ ID NO: 5717 - DNA, 17 bp; single-stranded, linear
cgagcccucaugucuga

SEQ ID NO: 5718 - DNA, 17 bp; single-stranded, linear
ccucaugucugaacuca

SEQ ID NO: 5719 - DNA, 17 bp; single-stranded, linear
ucugaacucaagauccu

SEQ ID NO: 5720 - DNA, 17 bp; single-stranded, linear
cucaagauccucaucca

SEQ ID NO: 5721 - DNA, 17 bp; single-stranded, linear
aagauccucauccacau

SEQ ID NO: 5722 - DNA, 17 bp; single-stranded, linear
auccucauccacauugg

SEQ ID NO: 5723 - DNA, 17 bp; single-stranded, linear
auccacauuggucacca

SEQ ID NO: 5724 - DNA, 17 bp; single-stranded, linear
acauuggucaccaucuc

SEQ ID NO: 5725 - DNA, 17 bp; single-stranded, linear
gucaccaucucaaugug

SEQ ID NO: 5726 - DNA, 17 bp; single-stranded, linear
caccaucucaauguggu

SEQ ID NO: 5727 - DNA, 17 bp; single-stranded, linear
gugaaccuccuaggcgc

SEQ ID NO: 5728 - DNA, 17 bp; single-stranded, linear
aaccuccuaggcgccug

SEQ ID NO: 5729 - DNA, 17 bp; single-stranded, linear
gagggccucucauggug

SEQ ID NO: 5730 - DNA, 17 bp; single-stranded, linear
gggccucucauggugau

SEQ ID NO: 5731 - DNA, 17 bp; single-stranded, linear
auggugauuguggaauu

SEQ ID NO: 5732 - DNA, 17 bp; single-stranded, linear
uguggaauucugcaagu

SEQ ID NO: 5733 - DNA, 17 bp; single-stranded, linear
guggaauucugcaaguu

SEQ ID NO: 5734 - DNA, 17 bp; single-stranded, linear
cugcaaguuuggaaacc

SEQ ID NO: 5735 - DNA, 17 bp; single-stranded, linear
ugcaaguuuggaaaccu

SEQ ID NO: 5736 - DNA, 17 bp; single-stranded, linear
ggaaaccuaucaacuua

SEQ ID NO: 5737 - DNA, 17 bp; single-stranded, linear
aaaccuaucaacuuacu

SEQ ID NO: 5738 - DNA, 17 bp; single-stranded, linear
uaucaacuuacuuacgg

SEQ ID NO: 5739 - DNA, 17 bp; single-stranded, linear
aucaacuuacuuacggg

SEQ ID NO: 5740 - DNA, 17 bp; single-stranded, linear
aacuuacuuacggggca

SEQ ID NO: 5741 - DNA, 17 bp; single-stranded, linear
acuuacuuacggggcaa

SEQ ID NO: 5742 - DNA, 17 bp; single-stranded, linear
aaaugaauuuguucccu

SEQ ID NO: 5743 - DNA, 17 bp; single-stranded, linear
aaugaauuuguucccua

SEQ ID NO: 5744 - DNA, 17 bp; single-stranded, linear
gaauuuguucccuauaa

SEQ ID NO: 5745 - DNA, 17 bp; single-stranded, linear
aauuuguucccuauaag

SEQ ID NO: 5746 - DNA, 17 bp; single-stranded, linear
uguucccuauaagagca

SEQ ID NO: 5747 - DNA, 17 bp; single-stranded, linear
uucccuauaagagcaaa

SEQ ID NO: 5748 - DNA, 17 bp; single-stranded, linear
ggcacgcuuccgccagg

SEQ ID NO: 5749 - DNA, 17 bp; single-stranded, linear
gcacgcuuccgccaggg

SEQ ID NO: 5750 - DNA, 17 bp; single-stranded, linear
caaggacuacguugggg

SEQ ID NO: 5751 - DNA, 17 bp; single-stranded, linear
gacuacguuggggagcu

SEQ ID NO: 5752 - DNA, 17 bp; single-stranded, linear
ggggagcucuccgugga

SEQ ID NO: 5753 - DNA, 17 bp; single-stranded, linear
ggagcucuccguggauc

SEQ ID NO: 5754 - DNA, 17 bp; single-stranded, linear
ccguggaucugaaaaga

SEQ ID NO: 5755 - DNA, 17 bp; single-stranded, linear
aagacgcuuggacagca

SEQ ID NO: 5756 - DNA, 17 bp; single-stranded, linear
gacagcaucaccagcag

SEQ ID NO: 5757 - DNA, 17 bp; single-stranded, linear
ccagagcucugccagcu

SEQ ID NO: 5758 - DNA, 17 bp; single-stranded, linear
ugccagcucaggcuuug

SEQ ID NO: 5759 - DNA, 17 bp; single-stranded, linear
cucaggcuuuguugagg

SEQ ID NO: 5760 - DNA, 17 bp; single-stranded, linear
ucaggcuuuguugagga

SEQ ID NO: 5761 - DNA, 17 bp; single-stranded, linear
ggcuuuguugaggagaa

SEQ ID NO: 5762 - DNA, 17 bp; single-stranded, linear
ggagaaaucgcucagug

SEQ ID NO: 5763 - DNA, 17 bp; single-stranded, linear
aaaucgcucagugaugu

SEQ ID NO: 5764 - DNA, 17 bp; single-stranded, linear
agugauguagaggaaga

SEQ ID NO: 5765 - DNA, 17 bp; single-stranded, linear
aagaagcuucugaagaa

SEQ ID NO: 5766 - DNA, 17 bp; single-stranded, linear
agaagcuucugaagaac

SEQ ID NO: 5767 - DNA, 17 bp; single-stranded, linear
agaacuguacaaggacu

SEQ ID NO: 5768 - DNA, 17 bp; single-stranded, linear
caaggacuuccugaccu

SEQ ID NO: 5769 - DNA, 17 bp; single-stranded, linear
aaggacuuccugaccuu

SEQ ID NO: 5770 - DNA, 17 bp; single-stranded, linear
ccugaccuuggagcauc

SEQ ID NO: 5771 - DNA, 17 bp; single-stranded, linear
uggagcaucucaucugu

SEQ ID NO: 5772 - DNA, 17 bp; single-stranded, linear
gagcaucucaucuguua

SEQ ID NO: 5773 - DNA, 17 bp; single-stranded, linear
caucucaucuguuacag

SEQ ID NO: 5774 - DNA, 17 bp; single-stranded, linear
ucaucuguuacagcuuc

SEQ ID NO: 5775 - DNA, 17 bp; single-stranded, linear
caucuguuacagcuucc

SEQ ID NO: 5776 - DNA, 17 bp; single-stranded, linear
uuacagcuuccaagugg

SEQ ID NO: 5777 - DNA, 17 bp; single-stranded, linear
uacagcuuccaaguggc

SEQ ID NO: 5778 - DNA, 17 bp; single-stranded, linear
aaguggcuaagggcaug

SEQ ID NO: 5779 - DNA, 17 bp; single-stranded, linear
cauggaguucuuggcau

SEQ ID NO: 5780 - DNA, 17 bp; single-stranded, linear
auggaguucuuggcauc

SEQ ID NO: 5781 - DNA, 17 bp; single-stranded, linear
ggaguucuuggcaucaa

SEQ ID NO: 5782 - DNA, 17 bp; single-stranded, linear
cuuggcaucaaggaagu

SEQ ID NO: 5783 - DNA, 17 bp; single-stranded, linear
ggaaguguauccacagg

SEQ ID NO: 5784 - DNA, 17 bp; single-stranded, linear
aaguguauccacaggga

SEQ ID NO: 5785 - DNA, 17 bp; single-stranded, linear
cgaaacauucuccuauc

SEQ ID NO: 5786 - DNA, 17 bp; single-stranded, linear
gaaacauucuccuaucg

SEQ ID NO: 5787 - DNA, 17 bp; single-stranded, linear
aacauucuccuaucgga

SEQ ID NO: 5788 - DNA, 17 bp; single-stranded, linear
auucuccuaucggagaa

SEQ ID NO: 5789 - DNA, 17 bp; single-stranded, linear
ucuccuaucggagaaga

SEQ ID NO: 5790 - DNA, 17 bp; single-stranded, linear
aaugugguuaagaucug

SEQ ID NO: 5791 - DNA, 17 bp; single-stranded, linear
augugguuaagaucugu

SEQ ID NO: 5792 - DNA, 17 bp; single-stranded, linear
guuaagaucugugacuu

SEQ ID NO: 5793 - DNA, 17 bp; single-stranded, linear
cugugacuucggcuugg

SEQ ID NO: 5794 - DNA, 17 bp; single-stranded, linear
ugugacuucggcuuggc

SEQ ID NO: 5795 - DNA, 17 bp; single-stranded, linear
cuucggcuuggcccggg

SEQ ID NO: 5796 - DNA, 17 bp; single-stranded, linear
cgggacauuuauaaaga

SEQ ID NO: 5797 - DNA, 17 bp; single-stranded, linear
gggacauuuauaaagac

SEQ ID NO: 5798 - DNA, 17 bp; single-stranded, linear
ggacauuuauaaagacc

SEQ ID NO: 5799 - DNA, 17 bp; single-stranded, linear
acauuuauaaagacccg

SEQ ID NO: 5800 - DNA, 17 bp; single-stranded, linear
acccggauuaugucaga

SEQ ID NO: 5801 - DNA, 17 bp; single-stranded, linear
cccggauuaugucagaa

SEQ ID NO: 5802 - DNA, 17 bp; single-stranded, linear
gauuaugucagaaaagg

SEQ ID NO: 5803 - DNA, 17 bp; single-stranded, linear
gcccgacucccuuugaa

SEQ ID NO: 5804 - DNA, 17 bp; single-stranded, linear
gacucccuuugaagugg

SEQ ID NO: 5805 - DNA, 17 bp; single-stranded, linear
acucccuuugaagugga

SEQ ID NO: 5806 - DNA, 17 bp; single-stranded, linear
gaaaccauuuuugacag

SEQ ID NO: 5807 - DNA, 17 bp; single-stranded, linear
aaaccauuuuugacaga

SEQ ID NO: 5808 - DNA, 17 bp; single-stranded, linear
aaccauuuuugacagag

SEQ ID NO: 5809 - DNA, 17 bp; single-stranded, linear
accauuuuugacagagu

SEQ ID NO: 5810 - DNA, 17 bp; single-stranded, linear
gacagaguauacacaau

SEQ ID NO: 5811 - DNA, 17 bp; single-stranded, linear
cagaguauacacaauuc

SEQ ID NO: 5812 - DNA, 17 bp; single-stranded, linear
uacacaauucagagcga

SEQ ID NO: 5813 - DNA, 17 bp; single-stranded, linear
acacaauucagagcgau

SEQ ID NO: 5814 - DNA, 17 bp; single-stranded, linear
uguguggucuuucggug

SEQ ID NO: 5815 - DNA, 17 bp; single-stranded, linear
uguggucuuucggugug

SEQ ID NO: 5816 - DNA, 17 bp; single-stranded, linear
guggucuuucggugugu

SEQ ID NO: 5817 - DNA, 17 bp; single-stranded, linear
uggucuuucgguguguu

SEQ ID NO: 5818 - DNA, 17 bp; single-stranded, linear
cgguguguugcucuggg

SEQ ID NO: 5819 - DNA, 17 bp; single-stranded, linear
guguugcucugggaaau

SEQ ID NO: 5820 - DNA, 17 bp; single-stranded, linear
ugggaaauauuuuccuu

SEQ ID NO: 5821 - DNA, 17 bp; single-stranded, linear
ggaaauauuuuccuuag

SEQ ID NO: 5822 - DNA, 17 bp; single-stranded, linear
gaaauauuuuccuuagg

SEQ ID NO: 5823 - DNA, 17 bp; single-stranded, linear
aaauauuuuccuuaggu

SEQ ID NO: 5824 - DNA, 17 bp; single-stranded, linear
aauauuuuccuuaggug

SEQ ID NO: 5825 - DNA, 17 bp; single-stranded, linear
auuuuccuuaggugccu

SEQ ID NO: 5826 - DNA, 17 bp; single-stranded, linear
uuuuccuuaggugccuc

SEQ ID NO: 5827 - DNA, 17 bp; single-stranded, linear
aggugccuccccauacc

SEQ ID NO: 5828 - DNA, 17 bp; single-stranded, linear
cuccccauacccugggg

SEQ ID NO: 5829 - DNA, 17 bp; single-stranded, linear
ccuggggucaagauuga

SEQ ID NO: 5830 - DNA, 17 bp; single-stranded, linear
gucaagauugaugaaga

SEQ ID NO: 5831 - DNA, 17 bp; single-stranded, linear
ugaagaauuuuguagga

SEQ ID NO: 5832 - DNA, 17 bp; single-stranded, linear
gaagaauuuuguaggag

SEQ ID NO: 5833 - DNA, 17 bp; single-stranded, linear
aagaauuuuguaggaga

SEQ ID NO: 5834 - DNA, 17 bp; single-stranded, linear
aauuuuguaggagauug

SEQ ID NO: 5835 - DNA, 17 bp; single-stranded, linear
uaggagauugaaagaag

SEQ ID NO: 5836 - DNA, 17 bp; single-stranded, linear
aaggaacuagaaugcgg

SEQ ID NO: 5837 - DNA, 17 bp; single-stranded, linear
ugcgggcuccugacuac

SEQ ID NO: 5838 - DNA, 17 bp; single-stranded, linear
uccugacuacacuaccc

SEQ ID NO: 5839 - DNA, 17 bp; single-stranded, linear
acuacacuaccccagaa

SEQ ID NO: 5840 - DNA, 17 bp; single-stranded, linear
agaaauguaccagacca

SEQ ID NO: 5841 - DNA, 17 bp; single-stranded, linear
gagacccucguuuucag

SEQ ID NO: 5842 - DNA, 17 bp; single-stranded, linear
acccucguuuucagagu

SEQ ID NO: 5843 - DNA, 17 bp; single-stranded, linear
cccucguuuucagaguu

SEQ ID NO: 5844 - DNA, 17 bp; single-stranded, linear
ccucguuuucagaguug

SEQ ID NO: 5845 - DNA, 17 bp; single-stranded, linear
cucguuuucagaguugg

SEQ ID NO: 5846 - DNA, 17 bp; single-stranded, linear
uucagaguugguggagc

SEQ ID NO: 5847 - DNA, 17 bp; single-stranded, linear
uggagcauuugggaaac

SEQ ID NO: 5848 - DNA, 17 bp; single-stranded, linear
ggagcauuugggaaacc

SEQ ID NO: 5849 - DNA, 17 bp; single-stranded, linear
ggaaaccuccugcaagc

SEQ ID NO: 5850 - DNA, 17 bp; single-stranded, linear
caaagacuauauuguuc

SEQ ID NO: 5851 - DNA, 17 bp; single-stranded, linear
aagacuauauuguucuu

SEQ ID NO: 5852 - DNA, 17 bp; single-stranded, linear
gacuauauuguucuucc

SEQ ID NO: 5853 - DNA, 17 bp; single-stranded, linear
uauauuguucuuccaau

SEQ ID NO: 5854 - DNA, 17 bp; single-stranded, linear
auauuguucuuccaaug

SEQ ID NO: 5855 - DNA, 17 bp; single-stranded, linear
auuguucuuccaauguc

SEQ ID NO: 5856 - DNA, 17 bp; single-stranded, linear
uuguucuuccaauguca

SEQ ID NO: 5857 - DNA, 17 bp; single-stranded, linear
uccaaugucagagacac

SEQ ID NO: 5858 - DNA, 17 bp; single-stranded, linear
aagaggauucuggacuc

SEQ ID NO: 5859 - DNA, 17 bp; single-stranded, linear
agaggauucuggacucu

SEQ ID NO: 5860 - DNA, 17 bp; single-stranded, linear
ucuggacucucccugcc

SEQ ID NO: 5861 - DNA, 17 bp; single-stranded, linear
uggacucucccugccua

SEQ ID NO: 5862 - DNA, 17 bp; single-stranded, linear
cccugccuaccucaccu

SEQ ID NO: 5863 - DNA, 17 bp; single-stranded, linear
gccuaccucaccuguuu

SEQ ID NO: 5864 - DNA, 17 bp; single-stranded, linear
ucaccuguuuccuguau

SEQ ID NO: 5865 - DNA, 17 bp; single-stranded, linear
caccuguuuccuguaug

SEQ ID NO: 5866 - DNA, 17 bp; single-stranded, linear
accuguuuccuguaugg

SEQ ID NO: 5867 - DNA, 17 bp; single-stranded, linear
uuuccuguauggaggaa

SEQ ID NO: 5868 - DNA, 17 bp; single-stranded, linear
ccccaaauuccauuaug

SEQ ID NO: 5869 - DNA, 17 bp; single-stranded, linear
cccaaauuccauuauga

SEQ ID NO: 5870 - DNA, 17 bp; single-stranded, linear
aauuccauuaugacaac

SEQ ID NO: 5871 - DNA, 17 bp; single-stranded, linear
auuccauuaugacaaca

SEQ ID NO: 5872 - DNA, 17 bp; single-stranded, linear
gcaggaaucagucauua

SEQ ID NO: 5873 - DNA, 17 bp; single-stranded, linear
gaaucagucauuaucuc

SEQ ID NO: 5874 - DNA, 17 bp; single-stranded, linear
ucagucauuaucuccag

SEQ ID NO: 5875 - DNA, 17 bp; single-stranded, linear
cagucauuaucuccaga

SEQ ID NO: 5876 - DNA, 17 bp; single-stranded, linear
gucauuaucuccagaac

SEQ ID NO: 5877 - DNA, 17 bp; single-stranded, linear
cauuaucuccagaacag

SEQ ID NO: 5878 - DNA, 17 bp; single-stranded, linear
agaacaguaagcgaaag

SEQ ID NO: 5879 - DNA, 17 bp; single-stranded, linear
gugaguguaaaaacauu

SEQ ID NO: 5880 - DNA, 17 bp; single-stranded, linear
aaaaacauuugaagaua

SEQ ID NO: 5881 - DNA, 17 bp; single-stranded, linear
aaaacauuugaagauau

SEQ ID NO: 5882 - DNA, 17 bp; single-stranded, linear
uugaagauaucccauug

SEQ ID NO: 5883 - DNA, 17 bp; single-stranded, linear
gaagauaucccauugga

SEQ ID NO: 5884 - DNA, 17 bp; single-stranded, linear
uaucccauuggaggaac

SEQ ID NO: 5885 - DNA, 17 bp; single-stranded, linear
ccagaaguaaaagugau

SEQ ID NO: 5886 - DNA, 17 bp; single-stranded, linear
aaagugaucccagauga

SEQ ID NO: 5887 - DNA, 17 bp; single-stranded, linear
gggaugguccuugcauc

SEQ ID NO: 5888 - DNA, 17 bp; single-stranded, linear
augguccuugcaucaga

SEQ ID NO: 5889 - DNA, 17 bp; single-stranded, linear
ccuugcaucagaagagc

SEQ ID NO: 5890 - DNA, 17 bp; single-stranded, linear
ugaaaacucuggaagac

SEQ ID NO: 5891 - DNA, 17 bp; single-stranded, linear
gaacaaauuaucuccau

SEQ ID NO: 5892 - DNA, 17 bp; single-stranded, linear
aacaaauuaucuccauc

SEQ ID NO: 5893 - DNA, 17 bp; single-stranded, linear
caaauuaucuccaucuu

SEQ ID NO: 5894 - DNA, 17 bp; single-stranded, linear
aauuaucuccaucuuuu

SEQ ID NO: 5895 - DNA, 17 bp; single-stranded, linear
aucuccaucuuuuggug

SEQ ID NO: 5896 - DNA, 17 bp; single-stranded, linear
cuccaucuuuuggugga

SEQ ID NO: 5897 - DNA, 17 bp; single-stranded, linear
uccaucuuuugguggaa

SEQ ID NO: 5898 - DNA, 17 bp; single-stranded, linear
ccaucuuuugguggaau

SEQ ID NO: 5899 - DNA, 17 bp; single-stranded, linear
ugcccaguaaaagcagg

SEQ ID NO: 5900 - DNA, 17 bp; single-stranded, linear
cagggagucuguggccu

SEQ ID NO: 5901 - DNA, 17 bp; single-stranded, linear
uguggccucggaaggcu

SEQ ID NO: 5902 - DNA, 17 bp; single-stranded, linear
ggaaggcuccaaccaga

SEQ ID NO: 5903 - DNA, 17 bp; single-stranded, linear
caguggcuaccagucug

SEQ ID NO: 5904 - DNA, 17 bp; single-stranded, linear
cuaccagucuggguauc

SEQ ID NO: 5905 - DNA, 17 bp; single-stranded, linear
gucuggguaucacucag

SEQ ID NO: 5906 - DNA, 17 bp; single-stranded, linear
cuggguaucacucagau

SEQ ID NO: 5907 - DNA, 17 bp; single-stranded, linear
guaucacucagaugaca

SEQ ID NO: 5908 - DNA, 17 bp; single-stranded, linear
caccguguacuccagcg

SEQ ID NO: 5909 - DNA, 17 bp; single-stranded, linear
cguguacuccagcgacg

SEQ ID NO: 5910 - DNA, 17 bp; single-stranded, linear
gcaggacuuuuaaagau

SEQ ID NO: 5911 - DNA, 17 bp; single-stranded, linear
caggacuuuuaaagaug

SEQ ID NO: 5912 - DNA, 17 bp; single-stranded, linear
aggacuuuuaaagaugg

SEQ ID NO: 5913 - DNA, 17 bp; single-stranded, linear
ggacuuuuaaagauggu

SEQ ID NO: 5914 - DNA, 17 bp; single-stranded, linear
gcugcaguucacgcuga

SEQ ID NO: 5915 - DNA, 17 bp; single-stranded, linear
cugcaguucacgcugac

SEQ ID NO: 5916 - DNA, 17 bp; single-stranded, linear
cgcugacucagggacca

SEQ ID NO: 5917 - DNA, 17 bp; single-stranded, linear
cugcagcucaccuccug

SEQ ID NO: 5918 - DNA, 17 bp; single-stranded, linear
gcucaccuccuguuuaa

SEQ ID NO: 5919 - DNA, 17 bp; single-stranded, linear
ccuccuguuuaaaugga

SEQ ID NO: 5920 - DNA, 17 bp; single-stranded, linear
cuccuguuuaaauggaa

SEQ ID NO: 5921 - DNA, 17 bp; single-stranded, linear
uccuguuuaaauggaag

SEQ ID NO: 5922 - DNA, 17 bp; single-stranded, linear
gaagugguccugucccg

SEQ ID NO: 5923 - DNA, 17 bp; single-stranded, linear
gguccugucccggcucc

SEQ ID NO: 5924 - DNA, 17 bp; single-stranded, linear
ucccggcuccgccccca

SEQ ID NO: 5925 - DNA, 17 bp; single-stranded, linear
ccccaacuccuggaaau

SEQ ID NO: 5926 - DNA, 17 bp; single-stranded, linear
cuggaaaucacgagaga

SEQ ID NO: 5927 - DNA, 17 bp; single-stranded, linear
gugcugcuuagauuuuc

SEQ ID NO: 5928 - DNA, 17 bp; single-stranded, linear
ugcugcuuagauuuuca

SEQ ID NO: 5929 - DNA, 17 bp; single-stranded, linear
gcuuagauuuucaagug

SEQ ID NO: 5930 - DNA, 17 bp; single-stranded, linear
cuuagauuuucaagugu

SEQ ID NO: 5931 - DNA, 17 bp; single-stranded, linear
uuagauuuucaaguguu

SEQ ID NO: 5932 - DNA, 17 bp; single-stranded, linear
uagauuuucaaguguug

SEQ ID NO: 5933 - DNA, 17 bp; single-stranded, linear
ucaaguguuguucuuuc

SEQ ID NO: 5934 - DNA, 17 bp; single-stranded, linear
aguguuguucuuuccac

SEQ ID NO: 5935 - DNA, 17 bp; single-stranded, linear
guguuguucuuuccacc

SEQ ID NO: 5936 - DNA, 17 bp; single-stranded, linear
guuguucuuuccaccac

SEQ ID NO: 5937 - DNA, 17 bp; single-stranded, linear
uuguucuuuccaccacc

SEQ ID NO: 5938 - DNA, 17 bp; single-stranded, linear
uguucuuuccaccaccc

SEQ ID NO: 5939 - DNA, 17 bp; single-stranded, linear
ccggaaguagccacauu

SEQ ID NO: 5940 - DNA, 17 bp; single-stranded, linear
agccacauuugauuuuc

SEQ ID NO: 5941 - DNA, 17 bp; single-stranded, linear
gccacauuugauuuuca

SEQ ID NO: 5942 - DNA, 17 bp; single-stranded, linear
cauuugauuuucauuuu

SEQ ID NO: 5943 - DNA, 17 bp; single-stranded, linear
auuugauuuucauuuuu

SEQ ID NO: 5944 - DNA, 17 bp; single-stranded, linear
uuugauuuucauuuuug

SEQ ID NO: 5945 - DNA, 17 bp; single-stranded, linear
uugauuuucauuuuugg

SEQ ID NO: 5946 - DNA, 17 bp; single-stranded, linear
auuuucauuuuuggagg

SEQ ID NO: 5947 - DNA, 17 bp; single-stranded, linear
uuuucauuuuuggagga

SEQ ID NO: 5948 - DNA, 17 bp; single-stranded, linear
uuucauuuuuggaggag

SEQ ID NO: 5949 - DNA, 17 bp; single-stranded, linear
uucauuuuuggaggagg

SEQ ID NO: 5950 - DNA, 17 bp; single-stranded, linear
agggaccucagacugca

SEQ ID NO: 5951 - DNA, 17 bp; single-stranded, linear
aaggagcuuguccucag

SEQ ID NO: 5952 - DNA, 17 bp; single-stranded, linear
gagcuuguccucagggc

SEQ ID NO: 5953 - DNA, 17 bp; single-stranded, linear
cuuguccucagggcauu

SEQ ID NO: 5954 - DNA, 17 bp; single-stranded, linear
cagggcauuuccagaga

SEQ ID NO: 5955 - DNA, 17 bp; single-stranded, linear
agggcauuuccagagaa

SEQ ID NO: 5956 - DNA, 17 bp; single-stranded, linear
gggcauuuccagagaag

SEQ ID NO: 5957 - DNA, 17 bp; single-stranded, linear
gaauguguugacucuac

SEQ ID NO: 5958 - DNA, 17 bp; single-stranded, linear
uguugacucuacucucu

SEQ ID NO: 5959 - DNA, 17 bp; single-stranded, linear
uugacucuacucucuuu

SEQ ID NO: 5960 - DNA, 17 bp; single-stranded, linear
acucuacucucuuuucc

SEQ ID NO: 5961 - DNA, 17 bp; single-stranded, linear
ucuacucucuuuuccau

SEQ ID NO: 5962 - DNA, 17 bp; single-stranded, linear
uacucucuuuuccauuc

SEQ ID NO: 5963 - DNA, 17 bp; single-stranded, linear
acucucuuuuccauuca

SEQ ID NO: 5964 - DNA, 17 bp; single-stranded, linear
cucucuuuuccauucau

SEQ ID NO: 5965 - DNA, 17 bp; single-stranded, linear
ucucuuuuccauucauu

SEQ ID NO: 5966 - DNA, 17 bp; single-stranded, linear
uuuuccauucauuuaaa

SEQ ID NO: 5967 - DNA, 17 bp; single-stranded, linear
uuuccauucauuuaaaa

SEQ ID NO: 5968 - DNA, 17 bp; single-stranded, linear
ccauucauuuaaaaguc

SEQ ID NO: 5969 - DNA, 17 bp; single-stranded, linear
cauucauuuaaaagucc

SEQ ID NO: 5970 - DNA, 17 bp; single-stranded, linear
auucauuuaaaaguccu

SEQ ID NO: 5971 - DNA, 17 bp; single-stranded, linear
uuaaaaguccuauauaa

SEQ ID NO: 5972 - DNA, 17 bp; single-stranded, linear
aaaguccuauauaaugu

SEQ ID NO: 5973 - DNA, 17 bp; single-stranded, linear
aguccuauauaaugugc

SEQ ID NO: 5974 - DNA, 17 bp; single-stranded, linear
uccuauauaaugugccc

SEQ ID NO: 5975 - DNA, 17 bp; single-stranded, linear
gcuguggucucacuacc

SEQ ID NO: 5976 - DNA, 17 bp; single-stranded, linear
uguggucucacuaccag

SEQ ID NO: 5977 - DNA, 17 bp; single-stranded, linear
gucucacuaccaguuaa

SEQ ID NO: 5978 - DNA, 17 bp; single-stranded, linear
cuaccaguuaaagcaaa

SEQ ID NO: 5979 - DNA, 17 bp; single-stranded, linear
uaccaguuaaagcaaaa

SEQ ID NO: 5980 - DNA, 17 bp; single-stranded, linear
aaaagacuuucaaacac

SEQ ID NO: 5981 - DNA, 17 bp; single-stranded, linear
aaagacuuucaaacacg

SEQ ID NO: 5982 - DNA, 17 bp; single-stranded, linear
aagacuuucaaacacgu

SEQ ID NO: 5983 - DNA, 17 bp; single-stranded, linear
cguggacucuguccucc

SEQ ID NO: 5984 - DNA, 17 bp; single-stranded, linear
gacucuguccuccaaga

SEQ ID NO: 5985 - DNA, 17 bp; single-stranded, linear
ucuguccuccaagaagu

SEQ ID NO: 5986 - DNA, 17 bp; single-stranded, linear
cggcaccucugugaaac

SEQ ID NO: 5987 - DNA, 17 bp; single-stranded, linear
aacuggaucgaaugggc

SEQ ID NO: 5988 - DNA, 17 bp; single-stranded, linear
gcaaugcuuuguguguu

SEQ ID NO: 5989 - DNA, 17 bp; single-stranded, linear
caaugcuuuguguguug

SEQ ID NO: 5990 - DNA, 17 bp; single-stranded, linear
uuguguguugaggaugg

SEQ ID NO: 5991 - DNA, 17 bp; single-stranded, linear
ugagaugucccagggcc

SEQ ID NO: 5992 - DNA, 17 bp; single-stranded, linear
ggccgagucugucuacc

SEQ ID NO: 5993 - DNA, 17 bp; single-stranded, linear
gagucugucuaccuugg

SEQ ID NO: 5994 - DNA, 17 bp; single-stranded, linear
gucugucuaccuuggag

SEQ ID NO: 5995 - DNA, 17 bp; single-stranded, linear
gucuaccuuggaggcuu

SEQ ID NO: 5996 - DNA, 17 bp; single-stranded, linear
uggaggcuuuguggagg

SEQ ID NO: 5997 - DNA, 17 bp; single-stranded, linear
ggaggcuuuguggagga

SEQ ID NO: 5998 - DNA, 17 bp; single-stranded, linear
ugcgggcuaugagccaa

SEQ ID NO: 5999 - DNA, 17 bp; single-stranded, linear
ccaaguguuaagugugg

SEQ ID NO: 6000 - DNA, 17 bp; single-stranded, linear
caaguguuaaguguggg

SEQ ID NO: 6001 - DNA, 17 bp; single-stranded, linear
gcgcaagucgcucggag

SEQ ID NO: 6002 - DNA, 17 bp; single-stranded, linear
aagucgcucggagagcg

SEQ ID NO: 6003 - DNA, 17 bp; single-stranded, linear
agagcgguuggagccug

SEQ ID NO: 6004 - DNA, 17 bp; single-stranded, linear
agaugcauugugcuggc

SEQ ID NO: 6005 - DNA, 17 bp; single-stranded, linear
ugcuggcucugguggag

SEQ ID NO: 6006 - DNA, 17 bp; single-stranded, linear
ggugggcuuguggccug

SEQ ID NO: 6007 - DNA, 17 bp; single-stranded, linear
uggccugucaggaaacg

SEQ ID NO: 6008 - DNA, 17 bp; single-stranded, linear
ggcaggguuugguuuug

SEQ ID NO: 6009 - DNA, 17 bp; single-stranded, linear
gcaggguuugguuuugg

SEQ ID NO: 6010 - DNA, 17 bp; single-stranded, linear
gguuugguuuuggaagg

SEQ ID NO: 6011 - DNA, 17 bp; single-stranded, linear
guuugguuuuggaaggu

SEQ ID NO: 6012 - DNA, 17 bp; single-stranded, linear
uuugguuuuggaagguu

SEQ ID NO: 6013 - DNA, 17 bp; single-stranded, linear
uggaagguuugcgugcu

SEQ ID NO: 6014 - DNA, 17 bp; single-stranded, linear
ggaagguuugcgugcuc

SEQ ID NO: 6015 - DNA, 17 bp; single-stranded, linear
ugcgugcucuucacagu

SEQ ID NO: 6016 - DNA, 17 bp; single-stranded, linear
cgugcucuucacagucg

SEQ ID NO: 6017 - DNA, 17 bp; single-stranded, linear
gugcucuucacagucgg

SEQ ID NO: 6018 - DNA, 17 bp; single-stranded, linear
uucacagucggguuaca

SEQ ID NO: 6019 - DNA, 17 bp; single-stranded, linear
agucggguuacaggcga

SEQ ID NO: 6020 - DNA, 17 bp; single-stranded, linear
gucggguuacaggcgag

SEQ ID NO: 6021 - DNA, 17 bp; single-stranded, linear
aggcgaguucccugugg

SEQ ID NO: 6022 - DNA, 17 bp; single-stranded, linear
ggcgaguucccuguggc

SEQ ID NO: 6023 - DNA, 17 bp; single-stranded, linear
uguggcguuuccuacuc

SEQ ID NO: 6024 - DNA, 17 bp; single-stranded, linear
guggcguuuccuacucc

SEQ ID NO: 6025 - DNA, 17 bp; single-stranded, linear
uggcguuuccuacuccu

SEQ ID NO: 6026 - DNA, 17 bp; single-stranded, linear
cguuuccuacuccuaau

SEQ ID NO: 6027 - DNA, 17 bp; single-stranded, linear
uuccuacuccuaaugag

SEQ ID NO: 6028 - DNA, 17 bp; single-stranded, linear
cuacuccuaaugagagu

SEQ ID NO: 6029 - DNA, 17 bp; single-stranded, linear
augagaguuccuuccgg

SEQ ID NO: 6030 - DNA, 17 bp; single-stranded, linear
ugagaguuccuuccgga

SEQ ID NO: 6031 - DNA, 17 bp; single-stranded, linear
gaguuccuuccggacuc

SEQ ID NO: 6032 - DNA, 17 bp; single-stranded, linear
aguuccuuccggacucu

SEQ ID NO: 6033 - DNA, 17 bp; single-stranded, linear
uccggacucuuacgugu

SEQ ID NO: 6034 - DNA, 17 bp; single-stranded, linear
cggacucuuacgugucu

SEQ ID NO: 6035 - DNA, 17 bp; single-stranded, linear
ggacucuuacgugucuc

SEQ ID NO: 6036 - DNA, 17 bp; single-stranded, linear
uuacgugucuccuggcc

SEQ ID NO: 6037 - DNA, 17 bp; single-stranded, linear
acgugucuccuggccug

SEQ ID NO: 6038 - DNA, 17 bp; single-stranded, linear
augcagcuugcuccuuc

SEQ ID NO: 6039 - DNA, 17 bp; single-stranded, linear
agcuugcuccuuccuca

SEQ ID NO: 6040 - DNA, 17 bp; single-stranded, linear
uugcuccuuccucaucu

SEQ ID NO: 6041 - DNA, 17 bp; single-stranded, linear
ugcuccuuccucaucuc

SEQ ID NO: 6042 - DNA, 17 bp; single-stranded, linear
uccuuccucaucucuca

SEQ ID NO: 6043 - DNA, 17 bp; single-stranded, linear
uuccucaucucucaggc

SEQ ID NO: 6044 - DNA, 17 bp; single-stranded, linear
ccucaucucucaggcug

SEQ ID NO: 6045 - DNA, 17 bp; single-stranded, linear
ucaucucucaggcugug

SEQ ID NO: 6046 - DNA, 17 bp; single-stranded, linear
cugugccuuaauucaga

SEQ ID NO: 6047 - DNA, 17 bp; single-stranded, linear
ugugccuuaauucagaa

SEQ ID NO: 6048 - DNA, 17 bp; single-stranded, linear
gccuuaauucagaacac

SEQ ID NO: 6049 - DNA, 17 bp; single-stranded, linear
ccuuaauucagaacacc

SEQ ID NO: 6050 - DNA, 17 bp; single-stranded, linear
aggaacgucggcagagg

SEQ ID NO: 6051 - DNA, 17 bp; single-stranded, linear
cagaggcuccugacggg

SEQ ID NO: 6052 - DNA, 17 bp; single-stranded, linear
cgaagaauugugagaac

SEQ ID NO: 6053 - DNA, 17 bp; single-stranded, linear
cagaaacucaggguuuc

SEQ ID NO: 6054 - DNA, 17 bp; single-stranded, linear
cucaggguuucugcugg

SEQ ID NO: 6055 - DNA, 17 bp; single-stranded, linear
ucaggguuucugcuggg

SEQ ID NO: 6056 - DNA, 17 bp; single-stranded, linear
caggguuucugcugggu

SEQ ID NO: 6057 - DNA, 17 bp; single-stranded, linear
uggcaggucugaggguu

SEQ ID NO: 6058 - DNA, 17 bp; single-stranded, linear
cugaggguucucuguca

SEQ ID NO: 6059 - DNA, 17 bp; single-stranded, linear
ugaggguucucugucaa

SEQ ID NO: 6060 - DNA, 17 bp; single-stranded, linear
aggguucucugucaagu

SEQ ID NO: 6061 - DNA, 17 bp; single-stranded, linear
uucucugucaaguggcg

SEQ ID NO: 6062 - DNA, 17 bp; single-stranded, linear
guggcgguaaaggcuca

SEQ ID NO: 6063 - DNA, 17 bp; single-stranded, linear
uaaaggcucaggcuggu

SEQ ID NO: 6064 - DNA, 17 bp; single-stranded, linear
gcugguguucuuccucu

SEQ ID NO: 6065 - DNA, 17 bp; single-stranded, linear
cugguguucuuccucua

SEQ ID NO: 6066 - DNA, 17 bp; single-stranded, linear
gguguucuuccucuauc

SEQ ID NO: 6067 - DNA, 17 bp; single-stranded, linear
guguucuuccucuaucu

SEQ ID NO: 6068 - DNA, 17 bp; single-stranded, linear
uucuuccucuaucucca

SEQ ID NO: 6069 - DNA, 17 bp; single-stranded, linear
cuuccucuaucuccacu

SEQ ID NO: 6070 - DNA, 17 bp; single-stranded, linear
uccucuaucuccacucc

SEQ ID NO: 6071 - DNA, 17 bp; single-stranded, linear
cucuaucuccacuccug

SEQ ID NO: 6072 - DNA, 17 bp; single-stranded, linear
ucuccacuccugucagg

SEQ ID NO: 6073 - DNA, 17 bp; single-stranded, linear
acuccugucaggccccc

SEQ ID NO: 6074 - DNA, 17 bp; single-stranded, linear
ccccaaguccucaguau

SEQ ID NO: 6075 - DNA, 17 bp; single-stranded, linear
caaguccucaguauuuu

SEQ ID NO: 6076 - DNA, 17 bp; single-stranded, linear
uccucaguauuuuagcu

SEQ ID NO: 6077 - DNA, 17 bp; single-stranded, linear
cucaguauuuuagcuuu

SEQ ID NO: 6078 - DNA, 17 bp; single-stranded, linear
ucaguauuuuagcuuug

SEQ ID NO: 6079 - DNA, 17 bp; single-stranded, linear
caguauuuuagcuuugu

SEQ ID NO: 6080 - DNA, 17 bp; single-stranded, linear
aguauuuuagcuuugug

SEQ ID NO: 6081 - DNA, 17 bp; single-stranded, linear
uuuuagcuuuguggcuu

SEQ ID NO: 6082 - DNA, 17 bp; single-stranded, linear
uuuagcuuuguggcuuc

SEQ ID NO: 6083 - DNA, 17 bp; single-stranded, linear
uuguggcuuccugaugg

SEQ ID NO: 6084 - DNA, 17 bp; single-stranded, linear
uguggcuuccugauggc

SEQ ID NO: 6085 - DNA, 17 bp; single-stranded, linear
agaaaaaucuuaauugg

SEQ ID NO: 6086 - DNA, 17 bp; single-stranded, linear
aaaaaucuuaauugguu

SEQ ID NO: 6087 - DNA, 17 bp; single-stranded, linear
aaaaucuuaauugguug

SEQ ID NO: 6088 - DNA, 17 bp; single-stranded, linear
aucuuaauugguugguu

SEQ ID NO: 6089 - DNA, 17 bp; single-stranded, linear
uaauugguugguuugcu

SEQ ID NO: 6090 - DNA, 17 bp; single-stranded, linear
ugguugguuugcucucc

SEQ ID NO: 6091 - DNA, 17 bp; single-stranded, linear
gguugguuugcucucca

SEQ ID NO: 6092 - DNA, 17 bp; single-stranded, linear
gguuugcucuccagaua

SEQ ID NO: 6093 - DNA, 17 bp; single-stranded, linear
uuugcucuccagauaau

SEQ ID NO: 6094 - DNA, 17 bp; single-stranded, linear
cuccagauaaucacuag

SEQ ID NO: 6095 - DNA, 17 bp; single-stranded, linear
cagauaaucacuagcca

SEQ ID NO: 6096 - DNA, 17 bp; single-stranded, linear
uaaucacuagccagauu

SEQ ID NO: 6097 - DNA, 17 bp; single-stranded, linear
agccagauuucgaaauu

SEQ ID NO: 6098 - DNA, 17 bp; single-stranded, linear
gccagauuucgaaauua

SEQ ID NO: 6099 - DNA, 17 bp; single-stranded, linear
ccagauuucgaaauuac

SEQ ID NO: 6100 - DNA, 17 bp; single-stranded, linear
uucgaaauuacuuuuua

SEQ ID NO: 6101 - DNA, 17 bp; single-stranded, linear
ucgaaauuacuuuuuag

SEQ ID NO: 6102 - DNA, 17 bp; single-stranded, linear
aaauuacuuuuuagccg

SEQ ID NO: 6103 - DNA, 17 bp; single-stranded, linear
aauuacuuuuuagccga

SEQ ID NO: 6104 - DNA, 17 bp; single-stranded, linear
auuacuuuuuagccgag

SEQ ID NO: 6105 - DNA, 17 bp; single-stranded, linear
uuacuuuuuagccgagg

SEQ ID NO: 6106 - DNA, 17 bp; single-stranded, linear
uacuuuuuagccgaggu

SEQ ID NO: 6107 - DNA, 17 bp; single-stranded, linear
gccgagguuaugauaac

SEQ ID NO: 6108 - DNA, 17 bp; single-stranded, linear
ccgagguuaugauaaca

SEQ ID NO: 6109 - DNA, 17 bp; single-stranded, linear
guuaugauaacaucuac

SEQ ID NO: 6110 - DNA, 17 bp; single-stranded, linear
gauaacaucuacuguau

SEQ ID NO: 6111 - DNA, 17 bp; single-stranded, linear
uaacaucuacuguaucc

SEQ ID NO: 6112 - DNA, 17 bp; single-stranded, linear
ucuacuguauccuuuag

SEQ ID NO: 6113 - DNA, 17 bp; single-stranded, linear
uacuguauccuuuagaa

SEQ ID NO: 6114 - DNA, 17 bp; single-stranded, linear
uguauccuuuagaauuu

SEQ ID NO: 6115 - DNA, 17 bp; single-stranded, linear
guauccuuuagaauuuu

SEQ ID NO: 6116 - DNA, 17 bp; single-stranded, linear
uauccuuuagaauuuua

SEQ ID NO: 6117 - DNA, 17 bp; single-stranded, linear
uuuagaauuuuaaccua

SEQ ID NO: 6118 - DNA, 17 bp; single-stranded, linear
uuagaauuuuaaccuau

SEQ ID NO: 6119 - DNA, 17 bp; single-stranded, linear
uagaauuuuaaccuaua

SEQ ID NO: 6120 - DNA, 17 bp; single-stranded, linear
agaauuuuaaccuauaa

SEQ ID NO: 6121 - DNA, 17 bp; single-stranded, linear
uuuaaccuauaaaacua

SEQ ID NO: 6122 - DNA, 17 bp; single-stranded, linear
uaaccuauaaaacuaug

SEQ ID NO: 6123 - DNA, 17 bp; single-stranded, linear
auaaaacuaugucuacu

SEQ ID NO: 6124 - DNA, 17 bp; single-stranded, linear
aacuaugucuacugguu

SEQ ID NO: 6125 - DNA, 17 bp; single-stranded, linear
cuaugucuacugguuuc

SEQ ID NO: 6126 - DNA, 17 bp; single-stranded, linear
cuacugguuucugccug

SEQ ID NO: 6127 - DNA, 17 bp; single-stranded, linear
uacugguuucugccugu

SEQ ID NO: 6128 - DNA, 17 bp; single-stranded, linear
acugguuucugccugug

SEQ ID NO: 6129 - DNA, 54 bp; single-stranded, linear
gggacacaagaagggcccaccagagaaacacacguugugguacauuaccuggua

SEQ ID NO: 6130 - DNA, 54 bp; single-stranded, linear
guuaucccagaagcgggaaccagagaaacacacguugugguacauuaccuggua

SEQ ID NO: 6131 - DNA, 54 bp; single-stranded, linear
ggaaucggagaagccaggaccagagaaacacacguugugguacauuaccuggua

SEQ ID NO: 6132 - DNA, 54 bp; single-stranded, linear
uccgcggaagaaggucagaccagagaaacacacguugugguacauuaccuggua

SEQ ID NO: 6133 - DNA, 54 bp; single-stranded, linear
cggcugucagaaguguccaccagagaaacacacguugugguacauuaccuggua

SEQ ID NO: 6134 - DNA, 54 bp; single-stranded, linear
ccagccgcagaagucagcaccagagaaacacacguugugguacauuaccuggua

SEQ ID NO: 6135 - DNA, 54 bp; single-stranded, linear
cuggcuccagaagcggcuaccagagaaacacacguugugguacauuaccuggua

SEQ ID NO: 6136 - DNA, 54 bp; single-stranded, linear
cagcgcaaagaaggggagaccagagaaacacacguugugguacauuaccuggua

SEQ ID NO: 6137 - DNA, 54 bp; single-stranded, linear
gucacagaagaaguauggaccagagaaacacacguugugguacauuaccuggua

SEQ ID NO: 6138 - DNA, 54 bp; single-stranded, linear
cacagagcagaagcuagcaccagagaaacacacguugugguacauuaccuggua

SEQ ID NO: 6139 - DNA, 54 bp; single-stranded, linear
cccacagaagaagcucggaccagagaaacacacguugugguacauuaccuggua

SEQ ID NO: 6140 - DNA, 54 bp; single-stranded, linear
ugcaaguaagaagaagggaccagagaaacacacguugugguacauuaccuggua

SEQ ID NO: 6141 - DNA, 54 bp; single-stranded, linear
uagacauaagaaguggagaccagagaaacacacguugugguacauuaccuggua

SEQ ID NO: 6142 - DNA, 54 bp; single-stranded, linear
gaauggugagaaguaaucaccagagaaacacacguugugguacauuaccuggua

SEQ ID NO: 6143 - DNA, 54 bp; single-stranded, linear
cgacccucagaaggggauaccagagaaacacacguugugguacauuaccuggua

SEQ ID NO: 6144 - DNA, 54 bp; single-stranded, linear
cuguuuccagaaggaacaaccagagaaacacacguugugguacauuaccuggua

SEQ ID NO: 6145 - DNA, 54 bp; single-stranded, linear
acaugauaagaagauaggaccagagaaacacacguugugguacauuaccuggua

SEQ ID NO: 6146 - DNA, 54 bp; single-stranded, linear
uuuucuccagaagauagcaccagagaaacacacguugugguacauuaccuggua

SEQ ID NO: 6147 - DNA, 54 bp; single-stranded, linear
ucuugaucagaaguccacaccagagaaacacacguugugguacauuaccuggua

SEQ ID NO: 6148 - DNA, 54 bp; single-stranded, linear
auaucaggagaaggguaaaccagagaaacacacguugugguacauuaccuggua

SEQ ID NO: 6149 - DNA, 54 bp; single-stranded, linear
ucucaccgagaaggggugaccagagaaacacacguugugguacauuaccuggua

SEQ ID NO: 6150 - DNA, 54 bp; single-stranded, linear
uuggcguaagaagugcauaccagagaaacacacguugugguacauuaccuggua

SEQ ID NO: 6151 - DNA, 54 bp; single-stranded, linear
ucuguaggagaaggcuucaccagagaaacacacguugugguacauuaccuggua

SEQ ID NO: 6152 - DNA, 54 bp; single-stranded, linear
uuggccggagaaguaggaaccagagaaacacacguugugguacauuaccuggua

SEQ ID NO: 6153 - DNA, 54 bp; single-stranded, linear
uuccuucaagaagggcauaccagagaaacacacguugugguacauuaccuggua

SEQ ID NO: 6154 - DNA, 54 bp; single-stranded, linear
ggcugggcagaagguugcaccagagaaacacacguugugguacauuaccuggua

SEQ ID NO: 6155 - DNA, 54 bp; single-stranded, linear
guuggcugagaagcagguaccagagaaacacacguugugguacauuaccuggua

SEQ ID NO: 6156 - DNA, 54 bp; single-stranded, linear
cagugcacagaagggacaaccagagaaacacacguugugguacauuaccuggua

SEQ ID NO: 6157 - DNA, 54 bp; single-stranded, linear
cccaugugagaagauguuaccagagaaacacacguugugguacauuaccuggua

SEQ ID NO: 6158 - DNA, 54 bp; single-stranded, linear; identical to SEQ ID NO: 4420

SEQ ID NO: 6159 - DNA, 54 bp; single-stranded, linear
uuaucuugagaagagcaaaccagagaaacacacguugugguacauuaccuggua

SEQ ID NO: 6160 - DNA, 54 bp; single-stranded, linear
ggaugaugagaaguuugaaccagagaaacacacguugugguacauuaccuggua

SEQ ID NO: 6161 - DNA, 54 bp; single-stranded, linear
ugcggauaagaagguuccaccagagaaacacacguugugguacauuaccuggua

SEQ ID NO: 6162 - DNA, 54 bp; single-stranded, linear
gcuuaacgagaaguaggaaccagagaaacacacguugugguacauuaccuggua

SEQ ID NO: 6163 - DNA, 54 bp; single-stranded, linear
ggcaauucagaaggauccaccagagaaacacacguugugguacauuaccuggua

SEQ ID NO: 6164 - DNA, 54 bp; single-stranded, linear
cuaguuucagaaggucccaccagagaaacacacguugugguacauuaccuggua

SEQ ID NO: 6165 - DNA, 54 bp; single-stranded, linear
ccaaaagcagaagccucaaccagagaaacacacguugugguacauuaccuggua

SEQ ID NO: 6166 - DNA, 54 bp; single-stranded, linear
aaagccugagaaggcagaaccagagaaacacacguugugguacauuaccuggua

SEQ ID NO: 6167 - DNA, 54 bp; single-stranded, linear; identical to SEQ ID NO: 4432

SEQ ID NO: 6168 - DNA, 54 bp; single-stranded, linear; identical to SEQ ID NO: 4433

SEQ ID NO: 6169 - DNA, 54 bp; single-stranded, linear
ccgggccaagaagaagucaccagagaaacacacguugugguacauuaccuggua

SEQ ID NO: 6170 - DNA, 54 bp; single-stranded, linear
cugacauaagaagggucuaccagagaaacacacguugugguacauuaccuggua

SEQ ID NO: 6171 - DNA, 54 bp; single-stranded, linear
caaagggaagaaggcaucaccagagaaacacacguugugguacauuaccuggua

SEQ ID NO: 6172 - DNA, 54 bp; single-stranded, linear
guaguguaagaaggagccaccagagaaacacacguugugguacauuaccuggua

SEQ ID NO: 6173 - DNA, 54 bp; single-stranded, linear; identical to SEQ ID NO: 4436

SEQ ID NO: 6174 - DNA, 54 bp; single-stranded, linear
cucaugccagaaguccagaccagagaaacacacguugugguacauuaccuggua

SEQ ID NO: 6175 - DNA, 54 bp; single-stranded, linear
gugagguaagaagggagaaccagagaaacacacguugugguacauuaccuggua

SEQ ID NO: 6176 - DNA, 54 bp; single-stranded, linear; identical to SEQ ID NO: 4439

SEQ ID NO: 6177 - DNA, 54 bp; single-stranded, linear
uggcugucagaagggaucaccagagaaacacacguugugguacauuaccuggua

SEQ ID NO: 6178 - DNA, 54 bp; single-stranded, linear
agccacugagaagguuggaccagagaaacacacguugugguacauuaccuggua

SEQ ID NO: 6179 - DNA, 54 bp; single-stranded, linear
gauacccaagaagguagcaccagagaaacacacguugugguacauuaccuggua

SEQ ID NO: 6180 - DNA, 54 bp; single-stranded, linear; identical to SEQ ID NO: 4444

SEQ ID NO: 6181 - DNA, 54 bp; single-stranded, linear
ucagcgugagaagcagcaaccagagaaacacacguugugguacauuaccuggua

SEQ ID NO: 6182 - DNA, 54 bp; single-stranded, linear
gucccugaagaagcgugaaccagagaaacacacguugugguacauuaccuggua

SEQ ID NO: 6183 - DNA, 54 bp; single-stranded, linear
aggaggugagaagcagugaccagagaaacacacguugugguacauuaccuggua

SEQ ID NO: 6184 - DNA, 54 bp; single-stranded, linear
uccauuuaagaaggagguaccagagaaacacacguugugguacauuaccuggua

SEQ ID NO: 6185 - DNA, 54 bp; single-stranded, linear
ggagccggagaaggaccaaccagagaaacacacguugugguacauuaccuggua

SEQ ID NO: 6186 - DNA, 54 bp; single-stranded, linear
gggggcggagaagggacaaccagagaaacacacguugugguacauuaccuggua

SEQ ID NO: 6187 - DNA, 54 bp; single-stranded, linear
gaguugggagaagagccgaccagagaaacacacguugugguacauuaccuggua

SEQ ID NO: 6188 - DNA, 54 bp; single-stranded, linear
aaaaucuaagaagcaccuaccagagaaacacacguugugguacauuaccuggua

SEQ ID NO: 6189 - DNA, 54 bp; single-stranded, linear
uccuugcaagaagaggucaccagagaaacacacguugugguacauuaccuggua

SEQ ID NO: 6190 - DNA, 54 bp; single-stranded, linear
gagaccacagaagggcacaccagagaaacacacguugugguacauuaccuggua

SEQ ID NO: 6191 - DNA, 54 bp; single-stranded, linear
ucuuggagagaagaguccaccagagaaacacacguugugguacauuaccuggua

SEQ ID NO: 6192 - DNA, 54 bp; single-stranded, linear
ccaagguaagaagacucgaccagagaaacacacguugugguacauuaccuggua

SEQ ID NO: 6193 - DNA, 54 bp; single-stranded, linear
caggcuccagaagcucucaccagagaaacacacguugugguacauuaccuggua

SEQ ID NO: 6194 - DNA, 54 bp; single-stranded, linear
cacaaugcagaagcaggcaccagagaaacacacguugugguacauuaccuggua

SEQ ID NO: 6195 - DNA, 54 bp; single-stranded, linear
acccugccagaagccuuuaccagagaaacacacguugugguacauuaccuggua

SEQ ID NO: 6196 - DNA, 54 bp; single-stranded, linear
uguaacccagaagugaagaccagagaaacacacguugugguacauuaccuggua

SEQ ID NO: 6197 - DNA, 54 bp; single-stranded, linear
acguaagaagaaggaaggaccagagaaacacacguugugguacauuaccuggua

SEQ ID NO: 6198 - DNA, 54 bp; single-stranded, linear
aaggagcaagaagcaucaaccagagaaacacacguugugguacauuaccuggua

SEQ ID NO: 6199 - DNA, 54 bp; single-stranded, linear
ucggccccagaaggagccaccagagaaacacacguugugguacauuaccuggua

SEQ ID NO: 6200 - DNA, 54 bp; single-stranded, linear
cuccacccagaagaaaccaccagagaaacacacguugugguacauuaccuggua

SEQ ID NO: 6201 - DNA, 54 bp; single-stranded, linear
uuucugccagaaggaagcaccagagaaacacacguugugguacauuaccuggua

SEQ ID NO: 6202 - DNA, 54 bp; single-stranded, linear
auuucgaaagaaggcuagaccagagaaacacacguugugguacauuaccuggua

SEQ ID NO: 6203 - DNA, 54 bp; single-stranded, linear
agcacacaagaagaaaccaccagagaaacacacguugugguacauuaccuggua

SEQ ID NO: 6204 - DNA, 18 bp; single-stranded, linear
gggcccagacuguguccc

SEQ ID NO: 6205 - DNA, 18 bp; single-stranded, linear
ucccgcagccgggauaac

SEQ ID NO: 6206 - DNA, 18 bp; single-stranded, linear
ccuggcugacccgauucc

SEQ ID NO: 6207 - DNA, 18 bp; single-stranded, linear
cugacccgauuccgcgga

SEQ ID NO: 6208 - DNA, 18 bp; single-stranded, linear
ggacaccgcugacagccg

SEQ ID NO: 6209 - DNA, 18 bp; single-stranded, linear
gcugacagccgcggcugg

SEQ ID NO: 6210 - DNA, 18 bp; single-stranded, linear
agccgcggcuggagccag

SEQ ID NO: 6211 - DNA, 18 bp; single-stranded, linear
cuccccggucuugcgcug

SEQ ID NO: 6212 - DNA, 18 bp; single-stranded, linear
ccauaccgccucugugac

SEQ ID NO: 6213 - DNA, 18 bp; single-stranded, linear
gcuagcugucgcucugug

SEQ ID NO: 6214 - DNA, 18 bp; single-stranded, linear
ccgagccgccucuguggg

SEQ ID NO: 6215 - DNA, 18 bp; single-stranded, linear
cccuucagauuacuugca

SEQ ID NO: 6216 - DNA, 18 bp; single-stranded, linear
cuccacuguuuaugucua

SEQ ID NO: 6217 - DNA, 18 bp; single-stranded, linear
gauuacagaucaccauuc

SEQ ID NO: 6218 - DNA, 18 bp; single-stranded, linear
auccccugccgagggucg

SEQ ID NO: 6219 - DNA, 18 bp; single-stranded, linear
uguuccggauggaaacag

SEQ ID NO: 6220 - DNA, 18 bp; single-stranded, linear
ccuaucagucuaucaugu

SEQ ID NO: 6221 - DNA, 18 bp; single-stranded, linear
gcuaucugccggagaaaa

SEQ ID NO: 6222 - DNA, 18 bp; single-stranded, linear
guggacggaugaucaaga

SEQ ID NO: 6223 - DNA, 18 bp; single-stranded, linear
uuacccagcuccugauau

SEQ ID NO: 6224 - DNA, 18 bp; single-stranded, linear
caccccagaucggugaga

SEQ ID NO: 6225 - DNA, 18 bp; single-stranded, linear
augcacagucuacgccaa

SEQ ID NO: 6226 - DNA, 18 bp; single-stranded, linear
gaagccugcuccuacaga

SEQ ID NO: 6227 - DNA, 18 bp; single-stranded, linear
uccuacagacccggccaa

SEQ ID NO: 6228 - DNA, 18 bp; single-stranded, linear
augcccugauugaaggaa

SEQ ID NO: 6229 - DNA, 18 bp; single-stranded, linear
gcaaccugcugcccagcc

SEQ ID NO: 6230 - DNA, 18 bp; single-stranded, linear
accugcugcccagccaac

SEQ ID NO: 6231 - DNA, 18 bp; single-stranded, linear
ugucccuguugugcacug

SEQ ID NO: 6232 - DNA, 18 bp; single-stranded, linear
aacaucgguccacauggg

SEQ ID NO: 6233 - DNA, 18 bp; single-stranded, linear
cacaccaguuugcaagaa

SEQ ID NO: 6234 - DNA, 18 bp; single-stranded, linear
uugcucugcucaagauaa

SEQ ID NO: 6235 - DNA, 18 bp; single-stranded, linear
ucaaacagcucaucaucc

SEQ ID NO: 6236 - DNA, 18 bp; single-stranded, linear
ggaaccugacuauccgca

SEQ ID NO: 6237 - DNA, 18 bp; single-stranded, linear
uccuacggaccguuaagc

SEQ ID NO: 6238 - DNA, 18 bp; single-stranded, linear
ggauccagaugaauugcc

SEQ ID NO: 6239 - DNA, 18 bp; single-stranded, linear
gggaccggcugaaacuag

SEQ ID NO: 6240 - DNA, 18 bp; single-stranded, linear
ugaggcagacgcuuuugg

SEQ ID NO: 6241 - DNA, 18 bp; single-stranded, linear
ucugccagcucaggcuuu

SEQ ID NO: 6242 - DNA, 18 bp; single-stranded, linear
acuuccugaccuuggagc

SEQ ID NO: 6243 - DNA, 18 bp; single-stranded, linear
uguuacagcuuccaagug

SEQ ID NO: 6244 - DNA, 18 bp; single-stranded, linear
gacuucggcuuggcccgg

SEQ ID NO: 6245 - DNA, 18 bp; single-stranded, linear
agacccggauuaugucag

SEQ ID NO: 6246 - DNA, 18 bp; single-stranded, linear
gaugcccgacucccuuug

SEQ ID NO: 6247 - DNA, 18 bp; single-stranded, linear
ggcuccugacuacacuac

SEQ ID NO: 6248 - DNA, 18 bp; single-stranded, linear
uguaccagaccaugcugg

SEQ ID NO: 6249 - DNA, 18 bp; single-stranded, linear
cuggacugcuggcaugag

SEQ ID NO: 6250 - DNA, 18 bp; single-stranded, linear
ucucccugccuaccucac

SEQ ID NO: 6251 - DNA, 18 bp; single-stranded, linear
cucaccuguuuccuguau

SEQ ID NO: 6252 - DNA, 18 bp; single-stranded, linear
gaucccagaugacagcca

SEQ ID NO: 6253 - DNA, 18 bp; single-stranded, linear
ccaaccagaccaguggcu

SEQ ID NO: 6254 - DNA, 18 bp; single-stranded, linear
gcuaccagucuggguauc

SEQ ID NO: 6255 - DNA, 18 bp; single-stranded, linear
ucacucagaugacacaga

SEQ ID NO: 6256 - DNA, 18 bp; single-stranded, linear
ugcugcaguucacgcuga

SEQ ID NO: 6257 - DNA, 18 bp; single-stranded, linear
ucacgcugacucagggac

SEQ ID NO: 6258 - DNA, 18 bp; single-stranded, linear
cacugcagcucaccuccu

SEQ ID NO: 6259 - DNA, 18 bp; single-stranded, linear
accuccuguuuaaaugga

SEQ ID NO: 6260 - DNA, 18 bp; single-stranded, linear
ugguccugucccggcucc

SEQ ID NO: 6261 - DNA, 18 bp; single-stranded, linear
ugucccggcuccgccccc

SEQ ID NO: 6262 - DNA, 18 bp; single-stranded, linear
cggcuccgcccccaacuc

SEQ ID NO: 6263 - DNA, 18 bp; single-stranded, linear
aggugcugcuuagauuuu

SEQ ID NO: 6264 - DNA, 18 bp; single-stranded, linear
gaccucagacugcaagga

SEQ ID NO: 6265 - DNA, 18 bp; single-stranded, linear
gugcccugcuguggucuc

SEQ ID NO: 6266 - DNA, 18 bp; single-stranded, linear
ggacucuguccuccaaga

SEQ ID NO: 6267 - DNA, 18 bp; single-stranded, linear
cgagucugucuaccuugg

SEQ ID NO: 6268 - DNA, 18 bp; single-stranded, linear
gagagcgguuggagccug

SEQ ID NO: 6269 - DNA, 18 bp; single-stranded, linear
gccugcagaugcauugug

SEQ ID NO: 6270 - DNA, 18 bp; single-stranded, linear
aaaggcggccggcagggu

SEQ ID NO: 6271 - DNA, 18 bp; single-stranded, linear
cuucacagucggguuaca

SEQ ID NO: 6272 - DNA, 18 bp; single-stranded, linear
ccuuccggacucuuacgu

SEQ ID NO: 6273 - DNA, 18 bp; single-stranded, linear
ugaugcagcuugcuccuu

SEQ ID NO: 6274 - DNA, 18 bp; single-stranded, linear
ggcuccugacggggccga

SEQ ID NO: 6275 - DNA, 18 bp; single-stranded, linear
gguuucugcuggguggag

SEQ ID NO: 6276 - DNA, 18 bp; single-stranded, linear
gcuuccugauggcagaaa

SEQ ID NO: 6277 - DNA, 18 bp; single-stranded, linear
cuagccagauuucgaaau

SEQ ID NO: 6278 - DNA, 18 bp; single-stranded, linear
gguuucugccugugugcu

SEQ ID NO: 6279 - DNA, 27 bp; single-stranded, linear
  The letter "N" represents the stem II region of an HH ribozyme.
gugagcaacugaugangaaacgcggcc

SEQ ID NO: 6280 - DNA, 27 bp; single-stranded, linear
  The letter "N" represents the stem II region of an HH ribozyme.
uggugagccugaugangaaagacgcgg

SEQ ID NO: 6281 - DNA, 27 bp; single-stranded, linear
  The letter "N" represents the stem II region of an HH ribozyme.
accauggucugaugangaaagcaagac

SEQ ID NO: 6282 - DNA, 27 bp; single-stranded, linear
  The letter "N" represents the stem II region of an HH ribozyme.
cagcagcucugaugangaaaccauggu

SEQ ID NO: 6283 - DNA, 27 bp; single-stranded, linear
  The letter "N" represents the stem II region of an HH ribozyme.
uaaggcaacugaugangaaaccgcggu

SEQ ID NO: 6284 - DNA, 27 bp; single-stranded, linear
  The letter "N" represents the stem II region of an HH ribozyme.
cguaaggccugaugangaaagaccgcg

SEQ ID NO: 6285 - DNA, 27 bp; single-stranded, linear
  The letter "N" represents the stem II region of an HH ribozyme.
cagcgcgucugaugangaaaggcaaga

SEQ ID NO: 6286 - DNA, 27 bp; single-stranded, linear
  The letter "N" represents the stem II region of an HH ribozyme.
gcagcgcgcugaugangaaaaggcaag

SEQ ID NO: 6287 - DNA, 27 bp; single-stranded, linear
  The letter "N" represents the stem II region of an HH ribozyme.
agacaccccugaugangaaagcagcgc

SEQ ID NO: 6288 - DNA, 27 bp; single-stranded, linear
  The letter "N" represents the stem II region of an HH ribozyme.
gagaagcacugaugangaaacacccga

SEQ ID NO: 6289 - DNA, 27 bp; single-stranded, linear
  The letter "N" represents the stem II region of an HH ribozyme.
ccugugagcugaugangaaagcagaca

SEQ ID NO: 6290 - DNA, 27 bp; single-stranded, linear
  The letter "N" represents the stem II region of an HH ribozyme.
uccugugacugaugangaaaagcagac

SEQ ID NO: 6291 - DNA, 27 bp; single-stranded, linear
  The letter "N" represents the stem II region of an HH ribozyme.
uauccugucugaugangaaagaagcag

SEQ ID NO: 6292 - DNA, 27 bp; single-stranded, linear
  The letter "N" represents the stem II region of an HH ribozyme.
cugagccacugaugangaaauccugug

SEQ ID NO: 6293 - DNA, 27 bp; single-stranded, linear
  The letter "N" represents the stem II region of an HH ribozyme.
ucgacccucugaugangaaagccauau

SEQ ID NO: 6294 - DNA, 27 bp; single-stranded, linear
  The letter "N" represents the stem II region of an HH ribozyme.
uuaacuuccugaugangaaacccugag

SEQ ID NO: 6295 - DNA, 27 bp; single-stranded, linear
  The letter "N" represents the stem II region of an HH ribozyme.
gcacuuuucugaugangaaacuucgac

SEQ ID NO: 6296 - DNA, 27 bp; single-stranded, linear
  The letter "N" represents the stem II region of an HH ribozyme.
ggcacuuucugaugangaaaacuucga

SEQ ID NO: 6297 - DNA, 27 bp; single-stranded, linear
  The letter "N" represents the stem II region of an HH ribozyme.
gccuuuuacugaugangaaacucaguu

SEQ ID NO: 6298 - DNA, 27 bp; single-stranded, linear
  The letter "N" represents the stem II region of an HH ribozyme.
ugccuuuucugaugangaaaacucagu

SEQ ID NO: 6299 - DNA, 27 bp; single-stranded, linear
  The letter "N" represents the stem II region of an HH ribozyme.
gugccuuucugaugangaaaaacucag

SEQ ID NO: 6300 - DNA, 27 bp; single-stranded, linear
  The letter "N" represents the stem II region of an HH ribozyme.
gcuugcaucugaugangaaacaugcug

SEQ ID NO: 6301 - DNA, 27 bp; single-stranded, linear
  The letter "N" represents the stem II region of an HH ribozyme.
gagaaagacugaugangaaagucuggc

SEQ ID NO: 6302 - DNA, 27 bp; single-stranded, linear
  The letter "N" represents the stem II region of an HH ribozyme.
uugagaaacugaugangaaagagucug

SEQ ID NO: 6303 - DNA, 27 bp; single-stranded, linear
  The letter "N" represents the stem II region of an HH ribozyme.
acuugagacugaugangaaagagaguc

SEQ ID NO: 6304 - DNA, 27 bp; single-stranded, linear
  The letter "N" represents the stem II region of an HH ribozyme.
cacuugagcugaugangaaaagagagu

SEQ ID NO: 6305 - DNA, 27 bp; single-stranded, linear
  The letter "N" represents the stem II region of an HH ribozyme.
gcacuugacugaugangaaaaagagag

SEQ ID NO: 6306 - DNA, 27 bp; single-stranded, linear
  The letter "N" represents the stem II region of an HH ribozyme.
cugcacuucugaugangaaagaaagag

SEQ ID NO: 6307 - DNA, 27 bp; single-stranded, linear
  The letter "N" represents the stem II region of an HH ribozyme.
gagaccaucugaugangaaagugggcu

SEQ ID NO: 6308 - DNA, 27 bp; single-stranded, linear
  The letter "N" represents the stem II region of an HH ribozyme.
ugggcagacugaugangaaaccaugag

SEQ ID NO: 6309 - DNA, 27 bp; single-stranded, linear
  The letter "N" represents the stem II region of an HH ribozyme.
cgugggcacugaugangaaagaccaug

SEQ ID NO: 6310 - DNA, 27 bp; single-stranded, linear
  The letter "N" represents the stem II region of an HH ribozyme.
gggggagucugaugangaaaugcucag

SEQ ID NO: 6311 - DNA, 27 bp; single-stranded, linear
  The letter "N" represents the stem II region of an HH ribozyme.
cgauggggcugaugangaaagugaugc

SEQ ID NO: 6312 - DNA, 27 bp; single-stranded, linear
  The letter "N" represents the stem II region of an HH ribozyme.
cacaggcccugaugangaaauggggga

SEQ ID NO: 6313 - DNA, 27 bp; single-stranded, linear
  The letter "N" represents the stem II region of an HH ribozyme.
uugccugucugaugangaaaucccucc

SEQ ID NO: 6314 - DNA, 27 bp; single-stranded, linear
  The letter "N" represents the stem II region of an HH ribozyme.
ugcugcagcugaugangaaauugccug

SEQ ID NO: 6315 - DNA, 27 bp; single-stranded, linear
  The letter "N" represents the stem II region of an HH ribozyme.
gugcugcacugaugangaaaauugccu

SEQ ID NO: 6316 - DNA, 27 bp; single-stranded, linear
  The letter "N" represents the stem II region of an HH ribozyme.
ccaagguccugaugangaaaggugcug

SEQ ID NO: 6317 - DNA, 27 bp; single-stranded, linear
  The letter "N" represents the stem II region of an HH ribozyme.
ccgugucccugaugangaaaggucaag

SEQ ID NO: 6318 - DNA, 27 bp; single-stranded, linear
  The letter "N" represents the stem II region of an HH ribozyme.
cagguguacugaugangaaaggcccgu

SEQ ID NO: 6319 - DNA, 27 bp; single-stranded, linear
  The letter "N" represents the stem II region of an HH ribozyme.
uacaggugcugaugangaaagaggccc

SEQ ID NO: 6320 - DNA, 27 bp; single-stranded, linear
  The letter "N" represents the stem II region of an HH ribozyme.
gagguauccugaugangaaacaggugu

SEQ ID NO: 6321 - DNA, 27 bp; single-stranded, linear
  The letter "N" represents the stem II region of an HH ribozyme.
uagggaggcugaugangaaaucuacag

SEQ ID NO: 6322 - DNA, 27 bp; single-stranded, linear
  The letter "N" represents the stem II region of an HH ribozyme.
gauguaggcugaugangaaagguaucu

SEQ ID NO: 6323 - DNA, 27 bp; single-stranded, linear
  The letter "N" represents the stem II region of an HH ribozyme.
aguagaugcugaugangaaagggaggu

SEQ ID NO: 6324 - DNA, 27 bp; single-stranded, linear
  The letter "N" represents the stem II region of an HH ribozyme.
ucgaaguacugaugangaaauguaggg

SEQ ID NO: 6325 - DNA, 27 bp; single-stranded, linear
  The letter "N" represents the stem II region of an HH ribozyme.
cuucgaagcugaugangaaagauguag

SEQ ID NO: 6326 - DNA, 27 bp; single-stranded, linear
  The letter "N" represents the stem II region of an HH ribozyme.
uuucuucgcugaugangaaaguagaug

SEQ ID NO: 6327 - DNA, 27 bp; single-stranded, linear
  The letter "N" represents the stem II region of an HH ribozyme.
uuuucuuccugaugangaaaaguagau

SEQ ID NO: 6328 - DNA, 27 bp; single-stranded, linear
  The letter "N" represents the stem II region of an HH ribozyme.
agauugaacugaugangaaauuccgcu

SEQ ID NO: 6329 - DNA, 27 bp; single-stranded, linear
  The letter "N" represents the stem II region of an HH ribozyme.
guagauugcugaugangaaagauuccg

SEQ ID NO: 6330 - DNA, 27 bp; single-stranded, linear
  The letter "N" represents the stem II region of an HH ribozyme.
uguagauucugaugangaaaagauucc

SEQ ID NO: 6331 - DNA, 27 bp; single-stranded, linear
  The letter "N" represents the stem II region of an HH ribozyme.
aauauguacugaugangaaauugaaga

SEQ ID NO: 6332 - DNA, 27 bp; single-stranded, linear
  The letter "N" represents the stem II region of an HH ribozyme.
caaauaugcugaugangaaagauugaa

SEQ ID NO: 6333 - DNA, 27 bp; single-stranded, linear
  The letter "N" represents the stem II region of an HH ribozyme.
cuaacaaacugaugangaaauguagau

SEQ ID NO: 6334 - DNA, 27 bp; single-stranded, linear
  The letter "N" represents the stem II region of an HH ribozyme.
cacuaacacugaugangaaauauguag

SEQ ID NO: 6335 - DNA, 27 bp; single-stranded, linear
  The letter "N" represents the stem II region of an HH ribozyme.
ucacuaaccugaugangaaaauaugua

SEQ ID NO: 6336 - DNA, 27 bp; single-stranded, linear
  The letter "N" represents the stem II region of an HH ribozyme.
gcaucacucugaugangaaacaaauau

SEQ ID NO: 6337 - DNA, 27 bp; single-stranded, linear
  The letter "N" represents the stem II region of an HH ribozyme.
ugcaucaccugaugangaaaacaaaua

SEQ ID NO: 6338 - DNA, 27 bp; single-stranded, linear
  The letter "N" represents the stem II region of an HH ribozyme.
uaugaaagcugaugangaaacucccug

SEQ ID NO: 6339 - DNA, 27 bp; single-stranded, linear
  The letter "N" represents the stem II region of an HH ribozyme.
cucuaugacugaugangaaaggacucc

SEQ ID NO: 6340 - DNA, 27 bp; single-stranded, linear
  The letter "N" represents the stem II region of an HH ribozyme.
ucucuaugcugaugangaaaaggacuc

SEQ ID NO: 6341 - DNA, 27 bp; single-stranded, linear
  The letter "N" represents the stem II region of an HH ribozyme.
aucucuaucugaugangaaaaaggacu

SEQ ID NO: 6342 - DNA, 27 bp; single-stranded, linear
  The letter "N" represents the stem II region of an HH ribozyme.
ugcaucuccugaugangaaaugaaagg

SEQ ID NO: 6343 - DNA, 27 bp; single-stranded, linear
  The letter "N" represents the stem II region of an HH ribozyme.
aguuugggcugaugangaaaugucagu

SEQ ID NO: 6344 - DNA, 27 bp; single-stranded, linear
  The letter "N" represents the stem II region of an HH ribozyme.
augugcaccugaugangaaaguuuggg

SEQ ID NO: 6345 - DNA, 27 bp; single-stranded, linear
  The letter "N" represents the stem II region of an HH ribozyme.
gggaugaucugaugangaaagcugucu

SEQ ID NO: 6346 - DNA, 27 bp; single-stranded, linear
  The letter "N" represents the stem II region of an HH ribozyme.
caggggaucugaugangaaaugagcug

SEQ ID NO: 6347 - DNA, 27 bp; single-stranded, linear
  The letter "N" represents the stem II region of an HH ribozyme.
cggcagggcugaugangaaaugaugag

SEQ ID NO: 6348 - DNA, 27 bp; single-stranded, linear
  The letter "N" represents the stem II region of an HH ribozyme.
cguugggucugaugangaaacgucacc

SEQ ID NO: 6349 - DNA, 27 bp; single-stranded, linear
  The letter "N" represents the stem II region of an HH ribozyme.
gugacugucugaugangaaacguuggg

SEQ ID NO: 6350 - DNA, 27 bp; single-stranded, linear
  The letter "N" represents the stem II region of an HH ribozyme.
uuuagggucugaugangaaacugugac

SEQ ID NO: 6351 - DNA, 27 bp; single-stranded, linear
  The letter "N" represents the stem II region of an HH ribozyme.
aacuuuuucugaugangaaagggugac

SEQ ID NO: 6352 - DNA, 27 bp; single-stranded, linear
  The letter "N" represents the stem II region of an HH ribozyme.
caaauggacugaugangaaacuuuuuu

SEQ ID NO: 6353 - DNA, 27 bp; single-stranded, linear
  The letter "N" represents the stem II region of an HH ribozyme.
ucaaauggcugaugangaaaacuuuuu

SEQ ID NO: 6354 - DNA, 27 bp; single-stranded, linear
  The letter "N" represents the stem II region of an HH ribozyme.
aucaaaugcugaugangaaaaacuuuu

SEQ ID NO: 6355 - DNA, 27 bp; single-stranded, linear
  The letter "N" represents the stem II region of an HH ribozyme.
gaguaucacugaugangaaauggaaac

SEQ ID NO: 6356 - DNA, 27 bp; single-stranded, linear
  The letter "N" represents the stem II region of an HH ribozyme.
agaguauccugaugangaaaauggaaa

SEQ ID NO: 6357 - DNA, 27 bp; single-stranded, linear
  The letter "N" represents the stem II region of an HH ribozyme.
gguaagagcugaugangaaaucaaaug

SEQ ID NO: 6358 - DNA, 27 bp; single-stranded, linear
  The letter "N" represents the stem II region of an HH ribozyme.
agggguaacugaugangaaaguaucaa

SEQ ID NO: 6359 - DNA, 27 bp; single-stranded, linear
  The letter "N" represents the stem II region of an HH ribozyme.
ucaggggucugaugangaaagaguauc

SEQ ID NO: 6360 - DNA, 27 bp; single-stranded, linear
  The letter "N" represents the stem II region of an HH ribozyme.
aucaggggcugaugangaaaagaguau

SEQ ID NO: 6361 - DNA, 27 bp; single-stranded, linear
  The letter "N" represents the stem II region of an HH ribozyme.
ucccaugucugaugangaaauucuuug

SEQ ID NO: 6362 - DNA, 27 bp; single-stranded, linear
  The letter "N" represents the stem II region of an HH ribozyme.
gccucucccugaugangaaacuguccc

SEQ ID NO: 6363 - DNA, 27 bp; single-stranded, linear
  The letter "N" represents the stem II region of an HH ribozyme.
cuauuauacugaugangaaagccucuc

SEQ ID NO: 6364 - DNA, 27 bp; single-stranded, linear
  The letter "N" represents the stem II region of an HH ribozyme.
gcuauuaucugaugangaaaagccucu

SEQ ID NO: 6365 - DNA, 27 bp; single-stranded, linear
  The letter "N" represents the stem II region of an HH ribozyme.
ugcuauuacugaugangaaaaagccuc

SEQ ID NO: 6366 - DNA, 27 bp; single-stranded, linear
  The letter "N" represents the stem II region of an HH ribozyme.
uuugcuaucugaugangaaauaaagcc

SEQ ID NO: 6367 - DNA, 27 bp; single-stranded, linear
  The letter "N" represents the stem II region of an HH ribozyme.
gcauuugccugaugangaaauuauaaa

SEQ ID NO: 6368 - DNA, 27 bp; single-stranded, linear
  The letter "N" represents the stem II region of an HH ribozyme.
ucucuuugcugaugangaaacguugca

SEQ ID NO: 6369 - DNA, 27 bp; single-stranded, linear
  The letter "N" represents the stem II region of an HH ribozyme.
agcagucccugaugangaaaucucuuu

SEQ ID NO: 6370 - DNA, 27 bp; single-stranded, linear
  The letter "N" represents the stem II region of an HH ribozyme.
ugcccguucugaugangaaacgguggc

SEQ ID NO: 6371 - DNA, 27 bp; single-stranded, linear
  The letter "N" represents the stem II region of an HH ribozyme.
uugucuggcugaugangaaacaggugc

SEQ ID NO: 6372 - DNA, 27 bp; single-stranded, linear
  The letter "N" represents the stem II region of an HH ribozyme.
gggucagacugaugangaaaguuuguc

SEQ ID NO: 6373 - DNA, 27 bp; single-stranded, linear
  The letter "N" represents the stem II region of an HH ribozyme.
augggucacugaugangaaauaguuug

SEQ ID NO: 6374 - DNA, 27 bp; single-stranded, linear
  The letter "N" represents the stem II region of an HH ribozyme.
ggucugcccugaugangaaauggguca

SEQ ID NO: 6375 - DNA, 27 bp; single-stranded, linear
  The letter "N" represents the stem II region of an HH ribozyme.
uaggauugcugaugangaaauuggucu

SEQ ID NO: 6376 - DNA, 27 bp; single-stranded, linear
  The letter "N" represents the stem II region of an HH ribozyme.
acaucuagcugaugangaaauuguauu

SEQ ID NO: 6377 - DNA, 27 bp; single-stranded, linear
  The letter "N" represents the stem II region of an HH ribozyme.
uggacauccugaugangaaaggauugu

SEQ ID NO: 6378 - DNA, 27 bp; single-stranded, linear
  The letter "N" represents the stem II region of an HH ribozyme.
cguauuugcugaugangaaacaucuag

SEQ ID NO: 6379 - DNA, 27 bp; single-stranded, linear
  The letter "N" represents the stem II region of an HH ribozyme.
ggcgggcgcugaugangaaauuuggac

SEQ ID NO: 6380 - DNA, 27 bp; single-stranded, linear
  The letter "N" represents the stem II region of an HH ribozyme.
ugcccgugcugaugangaaagcagucu

SEQ ID NO: 6381 - DNA, 27 bp; single-stranded, linear
  The letter "N" represents the stem II region of an HH ribozyme.
gaggacaacugaugangaaagucugcc

SEQ ID NO: 6382 - DNA, 27 bp; single-stranded, linear
  The letter "N" represents the stem II region of an HH ribozyme.
uugaggaccugaugangaaagagucug

SEQ ID NO: 6383 - DNA, 27 bp; single-stranded, linear
  The letter "N" represents the stem II region of an HH ribozyme.
caguugagcugaugangaaacaagagu

SEQ ID NO: 6384 - DNA, 27 bp; single-stranded, linear
  The letter "N" represents the stem II region of an HH ribozyme.
gugcaguucugaugangaaaggacaag

SEQ ID NO: 6385 - DNA, 27 bp; single-stranded, linear
  The letter "N" represents the stem II region of an HH ribozyme.
cucguauucugaugangaaagcuccgu

SEQ ID NO: 6386 - DNA, 27 bp; single-stranded, linear
  The letter "N" represents the stem II region of an HH ribozyme.
cacccucgcugaugangaaauugagcu

SEQ ID NO: 6387 - DNA, 27 bp; single-stranded, linear
  The letter "N" represents the stem II region of an HH ribozyme.
accagggucugaugangaaauuccagc

SEQ ID NO: 6388 - DNA, 27 bp; single-stranded, linear
  The letter "N" represents the stem II region of an HH ribozyme.
uaccagggcugaugangaaaauuccag

SEQ ID NO: 6389 - DNA, 27 bp; single-stranded, linear
  The letter "N" represents the stem II region of an HH ribozyme.
aguugcuucugaugangaaaccagggu

SEQ ID NO: 6390 - DNA, 27 bp; single-stranded, linear
  The letter "N" represents the stem II region of an HH ribozyme.
ugcucucucugaugangaaaguugcuu

SEQ ID NO: 6391 - DNA, 27 bp; single-stranded, linear
  The letter "N" represents the stem II region of an HH ribozyme.
gccuuauacugaugangaaaugcucuc

SEQ ID NO: 6392 - DNA, 27 bp; single-stranded, linear
  The letter "N" represents the stem II region of an HH ribozyme.
cugccuuacugaugangaaagaugcuc

SEQ ID NO: 6393 - DNA, 27 bp; single-stranded, linear
  The letter "N" represents the stem II region of an HH ribozyme.
cgcugccucugaugangaaauagaugc

SEQ ID NO: 6394 - DNA, 27 bp; single-stranded, linear
  The letter "N" represents the stem II region of an HH ribozyme.
cuccgguccugaugangaaauccgcug

SEQ ID NO: 6395 - DNA, 27 bp; single-stranded, linear
  The letter "N" represents the stem II region of an HH ribozyme.
guugugggcugaugangaaauggcucc

SEQ ID NO: 6396 - DNA, 27 bp; single-stranded, linear
  The letter "N" represents the stem II region of an HH ribozyme.
uguuguggcugaugangaaaauggcuc

SEQ ID NO: 6397 - DNA, 27 bp; single-stranded, linear
  The letter "N" represents the stem II region of an HH ribozyme.
cacuguggcugaugangaaacacauug

SEQ ID NO: 6398 - DNA, 27 bp; single-stranded, linear
  The letter "N" represents the stem II region of an HH ribozyme.
acacugugcugaugangaaaacacauu

SEQ ID NO: 6399 - DNA, 27 bp; single-stranded, linear
  The letter "N" represents the stem II region of an HH ribozyme.
aucuuaagcugaugangaaacacugug

SEQ ID NO: 6400 - DNA, 27 bp; single-stranded, linear
  The letter "N" represents the stem II region of an HH ribozyme.
gaucuuaacugaugangaaaacacugu

SEQ ID NO: 6401 - DNA, 27 bp; single-stranded, linear
  The letter "N" represents the stem II region of an HH ribozyme.
uugaucuucugaugangaaagaacacu

SEQ ID NO: 6402 - DNA, 27 bp; single-stranded, linear
  The letter "N" represents the stem II region of an HH ribozyme.
guugaucucugaugangaaaagaacac

SEQ ID NO: 6403 - DNA, 27 bp; single-stranded, linear
  The letter "N" represents the stem II region of an HH ribozyme.
acauuguucugaugangaaaucuuaag

SEQ ID NO: 6404 - DNA, 27 bp; single-stranded, linear
  The letter "N" represents the stem II region of an HH ribozyme.
cagguguacugaugangaaagccccuu

SEQ ID NO: 6405 - DNA, 27 bp; single-stranded, linear
  The letter "N" represents the stem II region of an HH ribozyme.
gacaggugcugaugangaaagagcccc

SEQ ID NO: 6406 - DNA, 27 bp; single-stranded, linear
  The letter "N" represents the stem II region of an HH ribozyme.
cuucacgccugaugangaaacaggugu

SEQ ID NO: 6407 - DNA, 27 bp; single-stranded, linear
  The letter "N" represents the stem II region of an HH ribozyme.
ggaacgagcugaugangaaacccacuc

SEQ ID NO: 6408 - DNA, 27 bp; single-stranded, linear
  The letter "N" represents the stem II region of an HH ribozyme.
acuggaaccugaugangaaaggaccca

SEQ ID NO: 6409 - DNA, 27 bp; single-stranded, linear
  The letter "N" represents the stem II region of an HH ribozyme.
aagacuggcugaugangaaacgaggac

SEQ ID NO: 6410 - DNA, 27 bp; single-stranded, linear
  The letter "N" represents the stem II region of an HH ribozyme.
aaagacugcugaugangaaaacgagga

SEQ ID NO: 6411 - DNA, 27 bp; single-stranded, linear
  The letter "N" represents the stem II region of an HH ribozyme.
uguugaaacugaugangaaacuggaac

SEQ ID NO: 6412 - DNA, 27 bp; single-stranded, linear
  The letter "N" represents the stem II region of an HH ribozyme.
gguguugacugaugangaaagacugga

SEQ ID NO: 6413 - DNA, 27 bp; single-stranded, linear
  The letter "N" represents the stem II region of an HH ribozyme.
agguguugcugaugangaaaagacugg

SEQ ID NO: 6414 - DNA, 27 bp; single-stranded, linear
  The letter "N" represents the stem II region of an HH ribozyme.
gagguguucugaugangaaaaagacug

SEQ ID NO: 6415 - DNA, 27 bp; single-stranded, linear
  The letter "N" represents the stem II region of an HH ribozyme.
caugcacgcugaugangaaagguguug

SEQ ID NO: 6416 - DNA, 27 bp; single-stranded, linear
  The letter "N" represents the stem II region of an HH ribozyme.
cuuuuucacugaugangaaacacaugc

SEQ ID NO: 6417 - DNA, 27 bp; single-stranded, linear
  The letter "N" represents the stem II region of an HH ribozyme.
cacugaugcugaugangaaauccuuuu

SEQ ID NO: 6418 - DNA, 27 bp; single-stranded, linear
  The letter "N" represents the stem II region of an HH ribozyme.
acacugaucugaugangaaaauccuuu

SEQ ID NO: 6419 - DNA, 27 bp; single-stranded, linear
  The letter "N" represents the stem II region of an HH ribozyme.
uucacacucugaugangaaaugaaucc

SEQ ID NO: 6420 - DNA, 27 bp; single-stranded, linear
  The letter "N" represents the stem II region of an HH ribozyme.
cugcuucccugaugangaaauguuuca

SEQ ID NO: 6421 - DNA, 27 bp; single-stranded, linear
  The letter "N" represents the stem II region of an HH ribozyme.
gccgauagcugaugangaaaccgucuu

SEQ ID NO: 6422 - DNA, 27 bp; single-stranded, linear
  The letter "N" represents the stem II region of an HH ribozyme.
acagccgacugaugangaaaggaccgu

SEQ ID NO: 6423 - DNA, 27 bp; single-stranded, linear
  The letter "N" represents the stem II region of an HH ribozyme.
ggacagcccugaugangaaauaggacc

SEQ ID NO: 6424 - DNA, 27 bp; single-stranded, linear
  The letter "N" represents the stem II region of an HH ribozyme.
cuuucaugcugaugangaaacagccga

SEQ ID NO: 6425 - DNA, 27 bp; single-stranded, linear
  The letter "N" represents the stem II region of an HH ribozyme.
gggaggggcugaugangaaaggccuuc

SEQ ID NO: 6426 - DNA, 27 bp; single-stranded, linear
  The letter "N" represents the stem II region of an HH ribozyme.
ggggagggcugaugangaaaaggccuu

SEQ ID NO: 6427 - DNA, 27 bp; single-stranded, linear
  The letter "N" represents the stem II region of an HH ribozyme.
uuucugggcugaugangaaaggggaag

SEQ ID NO: 6428 - DNA, 27 bp; single-stranded, linear
  The letter "N" represents the stem II region of an HH ribozyme.
aaccauaccugaugangaaauuucugg

SEQ ID NO: 6429 - DNA, 27 bp; single-stranded, linear
  The letter "N" represents the stem II region of an HH ribozyme.
uuuaaccacugaugangaaacgauuuc

SEQ ID NO: 6430 - DNA, 27 bp; single-stranded, linear
  The letter "N" represents the stem II region of an HH ribozyme.
caucuuuucugaugangaaaccauacg

SEQ ID NO: 6431 - DNA, 27 bp; single-stranded, linear
  The letter "N" represents the stem II region of an HH ribozyme.
ccaucuuucugaugangaaaaccauac

SEQ ID NO: 6432 - DNA, 27 bp; single-stranded, linear
  The letter "N" represents the stem II region of an HH ribozyme.
uugcaggccugaugangaaagccaucu

SEQ ID NO: 6433 - DNA, 27 bp; single-stranded, linear
  The letter "N" represents the stem II region of an HH ribozyme.
cagacuuccugaugangaaauguugca

SEQ ID NO: 6434 - DNA, 27 bp; single-stranded, linear
  The letter "N" represents the stem II region of an HH ribozyme.
agcgagcacugaugangaaacuucaau

SEQ ID NO: 6435 - DNA, 27 bp; single-stranded, linear
  The letter "N" represents the stem II region of an HH ribozyme.
caaauagccugaugangaaagcagacu

SEQ ID NO: 6436 - DNA, 27 bp; single-stranded, linear
  The letter "N" represents the stem II region of an HH ribozyme.
guaccaaacugaugangaaagcgagca

SEQ ID NO: 6437 - DNA, 27 bp; single-stranded, linear
  The letter "N" represents the stem II region of an HH ribozyme.
auguaccacugaugangaaauagcgag

SEQ ID NO: 6438 - DNA, 27 bp; single-stranded, linear
  The letter "N" represents the stem II region of an HH ribozyme.
cauguacccugaugangaaaauagcga

SEQ ID NO: 6439 - DNA, 27 bp; single-stranded, linear
  The letter "N" represents the stem II region of an HH ribozyme.
uagccaugcugaugangaaaccaaaua

SEQ ID NO: 6440 - DNA, 27 bp; single-stranded, linear
  The letter "N" represents the stem II region of an HH ribozyme.
uuaaugagcugaugangaaagccaugu

SEQ ID NO: 6441 - DNA, 27 bp; single-stranded, linear
  The letter "N" represents the stem II region of an HH ribozyme.
uaauuaaucugaugangaaaguagcca

SEQ ID NO: 6442 - DNA, 27 bp; single-stranded, linear
  The letter "N" represents the stem II region of an HH ribozyme.
ugauaauucugaugangaaaugaguag

SEQ ID NO: 6443 - DNA, 27 bp; single-stranded, linear
  The letter "N" represents the stem II region of an HH ribozyme.
uugauaaucugaugangaaaaugagua

SEQ ID NO: 6444 - DNA, 27 bp; single-stranded, linear
  The letter "N" represents the stem II region of an HH ribozyme.
ucuuugaucugaugangaaauuaauga

SEQ ID NO: 6445 - DNA, 27 bp; single-stranded, linear
  The letter "N" represents the stem II region of an HH ribozyme.
aucuuugacugaugangaaaauuaaug

SEQ ID NO: 6446 - DNA, 27 bp; single-stranded, linear
  The letter "N" represents the stem II region of an HH ribozyme.
acaucuuucugaugangaaauaauuaa

SEQ ID NO: 6447 - DNA, 27 bp; single-stranded, linear
  The letter "N" represents the stem II region of an HH ribozyme.
agaucguacugaugangaaaguccccu

SEQ ID NO: 6448 - DNA, 27 bp; single-stranded, linear
  The letter "N" represents the stem II region of an HH ribozyme.
caagaucgcugaugangaaauaguccc

SEQ ID NO: 6449 - DNA, 27 bp; single-stranded, linear
  The letter "N" represents the stem II region of an HH ribozyme.
cccagcaacugaugangaaaucguaua

SEQ ID NO: 6450 - DNA, 27 bp; single-stranded, linear
  The letter "N" represents the stem II region of an HH ribozyme.
ugcccagccugaugangaaagaucgua

SEQ ID NO: 6451 - DNA, 27 bp; single-stranded, linear
  The letter "N" represents the stem II region of an HH ribozyme.
gacugcuucugaugangaaaugcccag

SEQ ID NO: 6452 - DNA, 27 bp; single-stranded, linear
  The letter "N" represents the stem II region of an HH ribozyme.
auagccuucugaugangaaacugcuuu

SEQ ID NO: 6453 - DNA, 27 bp; single-stranded, linear
  The letter "N" represents the stem II region of an HH ribozyme.
uuuuuaaacugaugangaaagccuuga

SEQ ID NO: 6454 - DNA, 27 bp; single-stranded, linear
  The letter "N" represents the stem II region of an HH ribozyme.
gguuuuuacugaugangaaauagccuu

SEQ ID NO: 6455 - DNA, 27 bp; single-stranded, linear
  The letter "N" represents the stem II region of an HH ribozyme.
agguuuuucugaugangaaaauagccu

SEQ ID NO: 6456 - DNA, 27 bp; single-stranded, linear
  The letter "N" represents the stem II region of an HH ribozyme.
gagguuuucugaugangaaaaauagcc

SEQ ID NO: 6457 - DNA, 27 bp; single-stranded, linear
  The letter "N" represents the stem II region of an HH ribozyme.
guggcagucugaugangaaagguuuuu

SEQ ID NO: 6458 - DNA, 27 bp; single-stranded, linear
  The letter "N" represents the stem II region of an HH ribozyme.
uacaaugacugaugangaaaguggcag

SEQ ID NO: 6459 - DNA, 27 bp; single-stranded, linear
  The letter "N" represents the stem II region of an HH ribozyme.
uuuacaaucugaugangaaagaguggc

SEQ ID NO: 6460 - DNA, 27 bp; single-stranded, linear
  The letter "N" represents the stem II region of an HH ribozyme.
acguuuaccugaugangaaaugagagu

SEQ ID NO: 6461 - DNA, 27 bp; single-stranded, linear
  The letter "N" represents the stem II region of an HH ribozyme.
uucacguucugaugangaaacaaugag

SEQ ID NO: 6462 - DNA, 27 bp; single-stranded, linear
  The letter "N" represents the stem II region of an HH ribozyme.
guagaucucugaugangaaagguuuca

SEQ ID NO: 6463 - DNA, 27 bp; single-stranded, linear
  The letter "N" represents the stem II region of an HH ribozyme.
uuuucguacugaugangaaaucugagg

SEQ ID NO: 6464 - DNA, 27 bp; single-stranded, linear
  The letter "N" represents the stem II region of an HH ribozyme.
acuuuucgcugaugangaaagaucuga

SEQ ID NO: 6465 - DNA, 27 bp; single-stranded, linear
  The letter "N" represents the stem II region of an HH ribozyme.
aggacacgcugaugangaaacuuuucg

SEQ ID NO: 6466 - DNA, 27 bp; single-stranded, linear
  The letter "N" represents the stem II region of an HH ribozyme.
gaagcgagcugaugangaaacacggac

SEQ ID NO: 6467 - DNA, 27 bp; single-stranded, linear
  The letter "N" represents the stem II region of an HH ribozyme.
uuggaagccugaugangaaaggacacg

SEQ ID NO: 6468 - DNA, 27 bp; single-stranded, linear
  The letter "N" represents the stem II region of an HH ribozyme.
gggcuuggcugaugangaaagcgagga

SEQ ID NO: 6469 - DNA, 27 bp; single-stranded, linear
  The letter "N" represents the stem II region of an HH ribozyme.
ugggcuugcugaugangaaaagcgagg

SEQ ID NO: 6470 - DNA, 27 bp; single-stranded, linear
  The letter "N" represents the stem II region of an HH ribozyme.
cggauagacugaugangaaaggugggc

SEQ ID NO: 6471 - DNA, 27 bp; single-stranded, linear
  The letter "N" represents the stem II region of an HH ribozyme.
agcggauacugaugangaaagaggugg

SEQ ID NO: 6472 - DNA, 27 bp; single-stranded, linear
  The letter "N" represents the stem II region of an HH ribozyme.
ccagcggacugaugangaaagagaggu

SEQ ID NO: 6473 - DNA, 27 bp; single-stranded, linear
  The letter "N" represents the stem II region of an HH ribozyme.
gcccagcgcugaugangaaauagagag

SEQ ID NO: 6474 - DNA, 27 bp; single-stranded, linear
  The letter "N" represents the stem II region of an HH ribozyme.
caagugagcugaugangaaacuugucu

SEQ ID NO: 6475 - DNA, 27 bp; single-stranded, linear
  The letter "N" represents the stem II region of an HH ribozyme.
gugcaagucugaugangaaaggacuug

SEQ ID NO: 6476 - DNA, 27 bp; single-stranded, linear
  The letter "N" represents the stem II region of an HH ribozyme.
cacggugccugaugangaaagugagga

SEQ ID NO: 6477 - DNA, 27 bp; single-stranded, linear
  The letter "N" represents the stem II region of an HH ribozyme.
ggaugccacugaugangaaacacggug

SEQ ID NO: 6478 - DNA, 27 bp; single-stranded, linear
  The letter "N" represents the stem II region of an HH ribozyme.
ggccgaggcugaugangaaaugccaua

SEQ ID NO: 6479 - DNA, 27 bp; single-stranded, linear
  The letter "N" represents the stem II region of an HH ribozyme.
uguuggcccugaugangaaagggaugc

SEQ ID NO: 6480 - DNA, 27 bp; single-stranded, linear
  The letter "N" represents the stem II region of an HH ribozyme.
agccacgucugaugangaaauuguugg

SEQ ID NO: 6481 - DNA, 27 bp; single-stranded, linear
  The letter "N" represents the stem II region of an HH ribozyme.
gggugccacugaugangaaagccacgu

SEQ ID NO: 6482 - DNA, 27 bp; single-stranded, linear
  The letter "N" represents the stem II region of an HH ribozyme.
auuguggucugaugangaaacaggggu

SEQ ID NO: 6483 - DNA, 27 bp; single-stranded, linear
  The letter "N" represents the stem II region of an HH ribozyme.
uuuggagucugaugangaaauuguggu

SEQ ID NO: 6484 - DNA, 27 bp; single-stranded, linear
  The letter "N" represents the stem II region of an HH ribozyme.
uuucuuugcugaugangaaagugauug

SEQ ID NO: 6485 - DNA, 27 bp; single-stranded, linear
  The letter "N" represents the stem II region of an HH ribozyme.
agaagucacugaugangaaaccuuucu

SEQ ID NO: 6486 - DNA, 27 bp; single-stranded, linear
  The letter "N" represents the stem II region of an HH ribozyme.
cagugcagcugaugangaaagucauac

SEQ ID NO: 6487 - DNA, 27 bp; single-stranded, linear
  The letter "N" represents the stem II region of an HH ribozyme.
ucagugcacugaugangaaaagucaua

SEQ ID NO: 6488 - DNA, 27 bp; single-stranded, linear
  The letter "N" represents the stem II region of an HH ribozyme.
ggauaaagcugaugangaaauucuuca

SEQ ID NO: 6489 - DNA, 27 bp; single-stranded, linear
  The letter "N" represents the stem II region of an HH ribozyme.
ccaggauacugaugangaaaggauucu

SEQ ID NO: 6490 - DNA, 27 bp; single-stranded, linear
  The letter "N" represents the stem II region of an HH ribozyme.
uccaggaucugaugangaaaaggauuc

SEQ ID NO: 6491 - DNA, 27 bp; single-stranded, linear
  The letter "N" represents the stem II region of an HH ribozyme.
auccaggacugaugangaaaaaggauu

SEQ ID NO: 6492 - DNA, 27 bp; single-stranded, linear
  The letter "N" represents the stem II region of an HH ribozyme.
ggauccagcugaugangaaauaaagga

SEQ ID NO: 6493 - DNA, 27 bp; single-stranded, linear
  The letter "N" represents the stem II region of an HH ribozyme.
gcugcuggcugaugangaaauccagga

SEQ ID NO: 6494 - DNA, 27 bp; single-stranded, linear
  The letter "N" represents the stem II region of an HH ribozyme.
uguuuccucugaugangaaaguugcug

SEQ ID NO: 6495 - DNA, 27 bp; single-stranded, linear
  The letter "N" represents the stem II region of an HH ribozyme.
cuguuucccugaugangaaaaguugcu

SEQ ID NO: 6496 - DNA, 27 bp; single-stranded, linear
  The letter "N" represents the stem II region of an HH ribozyme.
augcucuccugaugangaaauucuguu

SEQ ID NO: 6497 - DNA, 27 bp; single-stranded, linear
  The letter "N" represents the stem II region of an HH ribozyme.
cgcugagacugaugangaaaugcucuc

SEQ ID NO: 6498 - DNA, 27 bp; single-stranded, linear
  The letter "N" represents the stem II region of an HH ribozyme.
ugcgcugacugaugangaaagaugcuc

SEQ ID NO: 6499 - DNA, 27 bp; single-stranded, linear
  The letter "N" represents the stem II region of an HH ribozyme.
caugcgcucugaugangaaagagaugc

SEQ ID NO: 6500 - DNA, 27 bp; single-stranded, linear
  The letter "N" represents the stem II region of an HH ribozyme.
ccuucuaucugaugangaaaccgucau

SEQ ID NO: 6501 - DNA, 27 bp; single-stranded, linear
  The letter "N" represents the stem II region of an HH ribozyme.
guuccuuccugaugangaaaugaccgu

SEQ ID NO: 6502 - DNA, 27 bp; single-stranded, linear
  The letter "N" represents the stem II region of an HH ribozyme.
aaccgucucugaugangaaauuuguuc

SEQ ID NO: 6503 - DNA, 27 bp; single-stranded, linear
  The letter "N" represents the stem II region of an HH ribozyme.
aaugugcucugaugangaaaccgucuu

SEQ ID NO: 6504 - DNA, 27 bp; single-stranded, linear
  The letter "N" represents the stem II region of an HH ribozyme.
caaugugccugaugangaaaaccgucu

SEQ ID NO: 6505 - DNA, 27 bp; single-stranded, linear
  The letter "N" represents the stem II region of an HH ribozyme.
ccaccacccugaugangaaaugugcua

SEQ ID NO: 6506 - DNA, 27 bp; single-stranded, linear
  The letter "N" represents the stem II region of an HH ribozyme.
gggucugacugaugangaaagucagcc

SEQ ID NO: 6507 - DNA, 27 bp; single-stranded, linear
  The letter "N" represents the stem II region of an HH ribozyme.
aggggucucugaugangaaagagucag

SEQ ID NO: 6508 - DNA, 27 bp; single-stranded, linear
  The letter "N" represents the stem II region of an HH ribozyme.
cagcuguacugaugangaaauuccagg

SEQ ID NO: 6509 - DNA, 27 bp; single-stranded, linear
  The letter "N" represents the stem II region of an HH ribozyme.
ggcagcugcugaugangaaagauucca

SEQ ID NO: 6510 - DNA, 27 bp; single-stranded, linear
  The letter "N" represents the stem II region of an HH ribozyme.
uuuuauugcugaugangaaaggcccgg

SEQ ID NO: 6511 - DNA, 27 bp; single-stranded, linear
  The letter "N" represents the stem II region of an HH ribozyme.
auuuuauucugaugangaaaaggcccg

SEQ ID NO: 6512 - DNA, 27 bp; single-stranded, linear
  The letter "N" represents the stem II region of an HH ribozyme.
cccuauuucugaugangaaauugaagg

SEQ ID NO: 6513 - DNA, 27 bp; single-stranded, linear
  The letter "N" represents the stem II region of an HH ribozyme.
acaguccccugaugangaaauuuuauu

SEQ ID NO: 6514 - DNA, 27 bp; single-stranded, linear
  The letter "N" represents the stem II region of an HH ribozyme.
uaaaauuucugaugangaaauguuucu

SEQ ID NO: 6515 - DNA, 27 bp; single-stranded, linear
  The letter "N" represents the stem II region of an HH ribozyme.
ugacauaacugaugangaaauuuuaug

SEQ ID NO: 6516 - DNA, 27 bp; single-stranded, linear
  The letter "N" represents the stem II region of an HH ribozyme.
gugacauacugaugangaaaauuuuau

SEQ ID NO: 6517 - DNA, 27 bp; single-stranded, linear
  The letter "N" represents the stem II region of an HH ribozyme.
ugugacaucugaugangaaaaauuuua

SEQ ID NO: 6518 - DNA, 27 bp; single-stranded, linear
  The letter "N" represents the stem II region of an HH ribozyme.
cugugacacugaugangaaaaaauuuu

SEQ ID NO: 6519 - DNA, 27 bp; single-stranded, linear
  The letter "N" represents the stem II region of an HH ribozyme.
acaucugucugaugangaaacauaaaa

SEQ ID NO: 6520 - DNA, 27 bp; single-stranded, linear
  The letter "N" represents the stem II region of an HH ribozyme.
aaacgugacugaugangaaagccauuc

SEQ ID NO: 6521 - DNA, 27 bp; single-stranded, linear
  The letter "N" represents the stem II region of an HH ribozyme.
gaaacgugcugaugangaaaagccauu

SEQ ID NO: 6522 - DNA, 27 bp; single-stranded, linear
  The letter "N" represents the stem II region of an HH ribozyme.
ggaaacgucugaugangaaaaagccau

SEQ ID NO: 6523 - DNA, 27 bp; single-stranded, linear
  The letter "N" represents the stem II region of an HH ribozyme.
uccaaggacugaugangaaacgugaaa

SEQ ID NO: 6524 - DNA, 27 bp; single-stranded, linear
  The letter "N" represents the stem II region of an HH ribozyme.
uuccaaggcugaugangaaaacgugaa

SEQ ID NO: 6525 - DNA, 27 bp; single-stranded, linear
  The letter "N" represents the stem II region of an HH ribozyme.
uuuccaagcugaugangaaaaacguga

SEQ ID NO: 6526 - DNA, 27 bp; single-stranded, linear
  The letter "N" represents the stem II region of an HH ribozyme.
ucuuuucccugaugangaaaggaaacg

SEQ ID NO: 6527 - DNA, 27 bp; single-stranded, linear
  The letter "N" represents the stem II region of an HH ribozyme.
ccacacagcugaugangaaacaguuuc

SEQ ID NO: 6528 - DNA, 27 bp; single-stranded, linear
  The letter "N" represents the stem II region of an HH ribozyme.
aauuuauucugaugangaaaccacaca

SEQ ID NO: 6529 - DNA, 27 bp; single-stranded, linear
  The letter "N" represents the stem II region of an HH ribozyme.
caggaauucugaugangaaauugacca

SEQ ID NO: 6530 - DNA, 27 bp; single-stranded, linear
  The letter "N" represents the stem II region of an HH ribozyme.
uguacaggcugaugangaaauuuauug

SEQ ID NO: 6531 - DNA, 27 bp; single-stranded, linear
  The letter "N" represents the stem II region of an HH ribozyme.
cuguacagcugaugangaaaauuuauu

SEQ ID NO: 6532 - DNA, 27 bp; single-stranded, linear
  The letter "N" represents the stem II region of an HH ribozyme.
ugucucugcugaugangaaacaggaau

SEQ ID NO: 6533 - DNA, 27 bp; single-stranded, linear
  The letter "N" represents the stem II region of an HH ribozyme.
auccaggucugaugangaaaugucucu

SEQ ID NO: 6534 - DNA, 27 bp; single-stranded, linear
  The letter "N" represents the stem II region of an HH ribozyme.
aauccaggcugaugangaaaaugucuc

SEQ ID NO: 6535 - DNA, 27 bp; single-stranded, linear
  The letter "N" represents the stem II region of an HH ribozyme.
cguagcagcugaugangaaauccaggu

SEQ ID NO: 6536 - DNA, 27 bp; single-stranded, linear
  The letter "N" represents the stem II region of an HH ribozyme.
ccguagcacugaugangaaaauccagg

SEQ ID NO: 6537 - DNA, 27 bp; single-stranded, linear
  The letter "N" represents the stem II region of an HH ribozyme.
acuguccgcugaugangaaagcagaau

SEQ ID NO: 6538 - DNA, 27 bp; single-stranded, linear
  The letter "N" represents the stem II region of an HH ribozyme.
cuguuguucugaugangaaacuguccg

SEQ ID NO: 6539 - DNA, 27 bp; single-stranded, linear
  The letter "N" represents the stem II region of an HH ribozyme.
ucuguugucugaugangaaaacugucc

SEQ ID NO: 6540 - DNA, 27 bp; single-stranded, linear
  The letter "N" represents the stem II region of an HH ribozyme.
gcugauaccugaugangaaauggugca

SEQ ID NO: 6541 - DNA, 27 bp; single-stranded, linear
  The letter "N" represents the stem II region of an HH ribozyme.
cuugcugacugaugangaaacuauggu

SEQ ID NO: 6542 - DNA, 27 bp; single-stranded, linear
  The letter "N" represents the stem II region of an HH ribozyme.
ugcuugcucugaugangaaauacuaug

SEQ ID NO: 6543 - DNA, 27 bp; single-stranded, linear
  The letter "N" represents the stem II region of an HH ribozyme.
guaaucuucugaugangaaaguggugg

SEQ ID NO: 6544 - DNA, 27 bp; single-stranded, linear
  The letter "N" represents the stem II region of an HH ribozyme.
gauggagucugaugangaaaucuugag

SEQ ID NO: 6545 - DNA, 27 bp; single-stranded, linear
  The letter "N" represents the stem II region of an HH ribozyme.
ugauggagcugaugangaaaaucuuga

SEQ ID NO: 6546 - DNA, 27 bp; single-stranded, linear
  The letter "N" represents the stem II region of an HH ribozyme.
gagugaugcugaugangaaaguaaucu

SEQ ID NO: 6547 - DNA, 27 bp; single-stranded, linear
  The letter "N" represents the stem II region of an HH ribozyme.
uucagagucugaugangaaauggagua

SEQ ID NO: 6548 - DNA, 27 bp; single-stranded, linear
  The letter "N" represents the stem II region of an HH ribozyme.
aagguucacugaugangaaagugaugg

SEQ ID NO: 6549 - DNA, 27 bp; single-stranded, linear
  The letter "N" represents the stem II region of an HH ribozyme.
uugaugaccugaugangaaagguucag

SEQ ID NO: 6550 - DNA, 27 bp; single-stranded, linear
  The letter "N" represents the stem II region of an HH ribozyme.
uucuugaucugaugangaaacaagguu

SEQ ID NO: 6551 - DNA, 27 bp; single-stranded, linear
  The letter "N" represents the stem II region of an HH ribozyme.
acguucuucugaugangaaaugacaag

SEQ ID NO: 6552 - DNA, 27 bp; single-stranded, linear
  The letter "N" represents the stem II region of an HH ribozyme.
cuucuagacugaugangaaacacguuc

SEQ ID NO: 6553 - DNA, 27 bp; single-stranded, linear
  The letter "N" represents the stem II region of an HH ribozyme.
gucuucuacugaugangaaagacacgu

SEQ ID NO: 6554 - DNA, 27 bp; single-stranded, linear
  The letter "N" represents the stem II region of an HH ribozyme.
gagucuuccugaugangaaagagacac

SEQ ID NO: 6555 - DNA, 27 bp; single-stranded, linear
  The letter "N" represents the stem II region of an HH ribozyme.
aggugccccugaugangaaagucuucu

SEQ ID NO: 6556 - DNA, 27 bp; single-stranded, linear
  The letter "N" represents the stem II region of an HH ribozyme.
ugcacgcacugaugangaaaggugccc

SEQ ID NO: 6557 - DNA, 27 bp; single-stranded, linear
  The letter "N" represents the stem II region of an HH ribozyme.
ccuguguacugaugangaaauguuccu

SEQ ID NO: 6558 - DNA, 27 bp; single-stranded, linear
  The letter "N" represents the stem II region of an HH ribozyme.
ccccugugcugaugangaaauauguuc

SEQ ID NO: 6559 - DNA, 27 bp; single-stranded, linear
  The letter "N" represents the stem II region of an HH ribozyme.
uuccgaagcugaugangaaaugucuuc

SEQ ID NO: 6560 - DNA, 27 bp; single-stranded, linear
  The letter "N" represents the stem II region of an HH ribozyme.
gucuuccgcugaugangaaaggauguc

SEQ ID NO: 6561 - DNA, 27 bp; single-stranded, linear
  The letter "N" represents the stem II region of an HH ribozyme.
ugucuucccugaugangaaaaggaugu

SEQ ID NO: 6562 - DNA, 27 bp; single-stranded, linear
  The letter "N" represents the stem II region of an HH ribozyme.
cuaacgagcugaugangaaacuucugu

SEQ ID NO: 6563 - DNA, 27 bp; single-stranded, linear
  The letter "N" represents the stem II region of an HH ribozyme.
ucuaacgacugaugangaaaacuucug

SEQ ID NO: 6564 - DNA, 27 bp; single-stranded, linear
  The letter "N" represents the stem II region of an HH ribozyme.
ucucuaaccugaugangaaagaacuuc

SEQ ID NO: 6565 - DNA, 27 bp; single-stranded, linear
  The letter "N" represents the stem II region of an HH ribozyme.
gaaucucucugaugangaaacgagaac

SEQ ID NO: 6566 - DNA, 27 bp; single-stranded, linear
  The letter "N" represents the stem II region of an HH ribozyme.
cgaaucuccugaugangaaaacgagaa

SEQ ID NO: 6567 - DNA, 27 bp; single-stranded, linear
  The letter "N" represents the stem II region of an HH ribozyme.
cgcuuccgcugaugangaaaucucuaa

SEQ ID NO: 6568 - DNA, 27 bp; single-stranded, linear
  The letter "N" represents the stem II region of an HH ribozyme.
gcgcuucccugaugangaaaaucucua

SEQ ID NO: 6569 - DNA, 27 bp; single-stranded, linear
  The letter "N" represents the stem II region of an HH ribozyme.
agguuuugcugaugangaaagcaggug

SEQ ID NO: 6570 - DNA, 27 bp; single-stranded, linear
  The letter "N" represents the stem II region of an HH ribozyme.
gagguuuucugaugangaaaagcaggu

SEQ ID NO: 6571 - DNA, 27 bp; single-stranded, linear
  The letter "N" represents the stem II region of an HH ribozyme.
uagucacucugaugangaaagguuuug

SEQ ID NO: 6572 - DNA, 27 bp; single-stranded, linear
  The letter "N" represents the stem II region of an HH ribozyme.
agaccucgcugaugangaaagucacug

SEQ ID NO: 6573 - DNA, 27 bp; single-stranded, linear
  The letter "N" represents the stem II region of an HH ribozyme.
cugauggacugaugangaaaccucgua

SEQ ID NO: 6574 - DNA, 27 bp; single-stranded, linear
  The letter "N" represents the stem II region of an HH ribozyme.
cacugaugcugaugangaaagaccucg

SEQ ID NO: 6575 - DNA, 27 bp; single-stranded, linear
  The letter "N" represents the stem II region of an HH ribozyme.
gagccacucugaugangaaauggagac

SEQ ID NO: 6576 - DNA, 27 bp; single-stranded, linear
  The letter "N" represents the stem II region of an HH ribozyme.
aggucguacugaugangaaagccacug

SEQ ID NO: 6577 - DNA, 27 bp; single-stranded, linear
  The letter "N" represents the stem II region of an HH ribozyme.
uaaggucgcugaugangaaagagccac

SEQ ID NO: 6578 - DNA, 27 bp; single-stranded, linear
  The letter "N" represents the stem II region of an HH ribozyme.
gacagucucugaugangaaaggucgua

SEQ ID NO: 6579 - DNA, 27 bp; single-stranded, linear
  The letter "N" represents the stem II region of an HH ribozyme.
ugacaguccugaugangaaaaggucgu

SEQ ID NO: 6580 - DNA, 27 bp; single-stranded, linear
  The letter "N" represents the stem II region of an HH ribozyme.
ucuagcuucugaugangaaacagucua

SEQ ID NO: 6581 - DNA, 27 bp; single-stranded, linear
  The letter "N" represents the stem II region of an HH ribozyme.
gacaccuccugaugangaaagcuugac

SEQ ID NO: 6582 - DNA, 27 bp; single-stranded, linear
  The letter "N" represents the stem II region of an HH ribozyme.
ggcgcgggcugaugangaaacaccucu

SEQ ID NO: 6583 - DNA, 27 bp; single-stranded, linear
  The letter "N" represents the stem II region of an HH ribozyme.
agugaucucugaugangaaaggcgcgg

SEQ ID NO: 6584 - DNA, 27 bp; single-stranded, linear
  The letter "N" represents the stem II region of an HH ribozyme.
aaccaagucugaugangaaaucugagg

SEQ ID NO: 6585 - DNA, 27 bp; single-stranded, linear
  The letter "N" represents the stem II region of an HH ribozyme.
uuugaacccugaugangaaagugaucu

SEQ ID NO: 6586 - DNA, 27 bp; single-stranded, linear
  The letter "N" represents the stem II region of an HH ribozyme.
uguuuuugcugaugangaaaccaagug

SEQ ID NO: 6587 - DNA, 27 bp; single-stranded, linear
  The letter "N" represents the stem II region of an HH ribozyme.
uuguuuuucugaugangaaaaccaagu

SEQ ID NO: 6588 - DNA, 27 bp; single-stranded, linear
  The letter "N" represents the stem II region of an HH ribozyme.
ucuuguugcugaugangaaauuuugug

SEQ ID NO: 6589 - DNA, 27 bp; single-stranded, linear
  The letter "N" represents the stem II region of an HH ribozyme.
ccuaaaaucugaugangaaauucccgg

SEQ ID NO: 6590 - DNA, 27 bp; single-stranded, linear
  The letter "N" represents the stem II region of an HH ribozyme.
uccuaaaacugaugangaaaauucccg

SEQ ID NO: 6591 - DNA, 27 bp; single-stranded, linear
  The letter "N" represents the stem II region of an HH ribozyme.
gguccuaacugaugangaaauaauucc

SEQ ID NO: 6592 - DNA, 27 bp; single-stranded, linear
  The letter "N" represents the stem II region of an HH ribozyme.
ugguccuacugaugangaaaauaauuc

SEQ ID NO: 6593 - DNA, 27 bp; single-stranded, linear
  The letter "N" represents the stem II region of an HH ribozyme.
cugguccucugaugangaaaaauaauu

SEQ ID NO: 6594 - DNA, 27 bp; single-stranded, linear
  The letter "N" represents the stem II region of an HH ribozyme.
ccuggucccugaugangaaaaaauaau

SEQ ID NO: 6595 - DNA, 27 bp; single-stranded, linear
  The letter "N" represents the stem II region of an HH ribozyme.
uuucaauacugaugangaaacagcgug

SEQ ID NO: 6596 - DNA, 27 bp; single-stranded, linear
  The letter "N" represents the stem II region of an HH ribozyme.
cuuucaaucugaugangaaaacagcgu

SEQ ID NO: 6597 - DNA, 27 bp; single-stranded, linear
  The letter "N" represents the stem II region of an HH ribozyme.
ucuuucaacugaugangaaaaacagcg

SEQ ID NO: 6598 - DNA, 27 bp; single-stranded, linear
  The letter "N" represents the stem II region of an HH ribozyme.
acucuuuccugaugangaaauaaacag

SEQ ID NO: 6599 - DNA, 27 bp; single-stranded, linear
  The letter "N" represents the stem II region of an HH ribozyme.
uccucugucugaugangaaacucuuuc

SEQ ID NO: 6600 - DNA, 27 bp; single-stranded, linear
  The letter "N" represents the stem II region of an HH ribozyme.
caccuauacugaugangaaacacccuc

SEQ ID NO: 6601 - DNA, 27 bp; single-stranded, linear
  The letter "N" represents the stem II region of an HH ribozyme.
ggcaccuacugaugangaaagacaccc

SEQ ID NO: 6602 - DNA, 27 bp; single-stranded, linear
  The letter "N" represents the stem II region of an HH ribozyme.
ucggcacccugaugangaaauagacac

SEQ ID NO: 6603 - DNA, 27 bp; single-stranded, linear
  The letter "N" represents the stem II region of an HH ribozyme.
cggugaggcugaugangaaaggcugcg

SEQ ID NO: 6604 - DNA, 27 bp; single-stranded, linear
  The letter "N" represents the stem II region of an HH ribozyme.
ugcacggucugaugangaaagguaggc

SEQ ID NO: 6605 - DNA, 27 bp; single-stranded, linear
  The letter "N" represents the stem II region of an HH ribozyme.
acuugucucugaugangaaagguuccu

SEQ ID NO: 6606 - DNA, 27 bp; single-stranded, linear
  The letter "N" represents the stem II region of an HH ribozyme.
ccagguuucugaugangaaacuugucu

SEQ ID NO: 6607 - DNA, 27 bp; single-stranded, linear
  The letter "N" represents the stem II region of an HH ribozyme.
gugagcgucugaugangaaaucagcuc

SEQ ID NO: 6608 - DNA, 27 bp; single-stranded, linear
  The letter "N" represents the stem II region of an HH ribozyme.
gugcacgucugaugangaaagcgugau

SEQ ID NO: 6609 - DNA, 27 bp; single-stranded, linear
  The letter "N" represents the stem II region of an HH ribozyme.
agccaaaacugaugangaaagggucgc

SEQ ID NO: 6610 - DNA, 27 bp; single-stranded, linear
  The letter "N" represents the stem II region of an HH ribozyme.
ggagccaacugaugangaaagaggguc

SEQ ID NO: 6611 - DNA, 27 bp; single-stranded, linear
  The letter "N" represents the stem II region of an HH ribozyme.
aggagccacugaugangaaaagagggu

SEQ ID NO: 6612 - DNA, 27 bp; single-stranded, linear
  The letter "N" represents the stem II region of an HH ribozyme.
aaggagcccugaugangaaaaagaggg

SEQ ID NO: 6613 - DNA, 27 bp; single-stranded, linear
  The letter "N" represents the stem II region of an HH ribozyme.
guuagaagcugaugangaaagccaaaa

SEQ ID NO: 6614 - DNA, 27 bp; single-stranded, linear
  The letter "N" represents the stem II region of an HH ribozyme.
agaguuagcugaugangaaaggagcca

SEQ ID NO: 6615 - DNA, 27 bp; single-stranded, linear
  The letter "N" represents the stem II region of an HH ribozyme.
gagaguuacugaugangaaaaggagcc

SEQ ID NO: 6616 - DNA, 27 bp; single-stranded, linear
  The letter "N" represents the stem II region of an HH ribozyme.
aagagagucugaugangaaagaaggag

SEQ ID NO: 6617 - DNA, 27 bp; single-stranded, linear
  The letter "N" represents the stem II region of an HH ribozyme.
gaugaagacugaugangaaaguuagaa

SEQ ID NO: 6618 - DNA, 27 bp; single-stranded, linear
  The letter "N" represents the stem II region of an HH ribozyme.
cugaugaacugaugangaaagaguuag

SEQ ID NO: 6619 - DNA, 27 bp; single-stranded, linear
  The letter "N" represents the stem II region of an HH ribozyme.
uucugaugcugaugangaaagagaguu

SEQ ID NO: 6620 - DNA, 27 bp; single-stranded, linear
  The letter "N" represents the stem II region of an HH ribozyme.
uuucugaucugaugangaaaagagagu

SEQ ID NO: 6621 - DNA, 27 bp; single-stranded, linear
  The letter "N" represents the stem II region of an HH ribozyme.
aguuuucucugaugangaaaugaagag

SEQ ID NO: 6622 - DNA, 27 bp; single-stranded, linear
  The letter "N" represents the stem II region of an HH ribozyme.
cggaagaacugaugangaaaccgcuuc

SEQ ID NO: 6623 - DNA, 27 bp; single-stranded, linear
  The letter "N" represents the stem II region of an HH ribozyme.
uucggaagcugaugangaaagaccgcu

SEQ ID NO: 6624 - DNA, 27 bp; single-stranded, linear
  The letter "N" represents the stem II region of an HH ribozyme.
cuucggaacugaugangaaaagaccgc

SEQ ID NO: 6625 - DNA, 27 bp; single-stranded, linear
  The letter "N" represents the stem II region of an HH ribozyme.
uacuucggcugaugangaaagaagacc

SEQ ID NO: 6626 - DNA, 27 bp; single-stranded, linear
  The letter "N" represents the stem II region of an HH ribozyme.
uuacuucgcugaugangaaaagaagac

SEQ ID NO: 6627 - DNA, 27 bp; single-stranded, linear
  The letter "N" represents the stem II region of an HH ribozyme.
ucugucuucugaugangaaacuucgga

SEQ ID NO: 6628 - DNA, 27 bp; single-stranded, linear
  The letter "N" represents the stem II region of an HH ribozyme.
uugacaggcugaugangaaagucuguc

SEQ ID NO: 6629 - DNA, 27 bp; single-stranded, linear
  The letter "N" represents the stem II region of an HH ribozyme.
uaaugauucugaugangaaacagguag

SEQ ID NO: 6630 - DNA, 27 bp; single-stranded, linear
  The letter "N" represents the stem II region of an HH ribozyme.
uccauaaucugaugangaaauugacag

SEQ ID NO: 6631 - DNA, 27 bp; single-stranded, linear
  The letter "N" represents the stem II region of an HH ribozyme.
ggguccaucugaugangaaaugauuga

SEQ ID NO: 6632 - DNA, 27 bp; single-stranded, linear
  The letter "N" represents the stem II region of an HH ribozyme.
uggguccacugaugangaaaaugauug

SEQ ID NO: 6633 - DNA, 27 bp; single-stranded, linear
  The letter "N" represents the stem II region of an HH ribozyme.
uccaggggcugaugangaaacuucauc

SEQ ID NO: 6634 - DNA, 27 bp; single-stranded, linear
  The letter "N" represents the stem II region of an HH ribozyme.
auccagggcugaugangaaaacuucau

SEQ ID NO: 6635 - DNA, 27 bp; single-stranded, linear
  The letter "N" represents the stem II region of an HH ribozyme.
uggcaucacugaugangaaagggcagc

SEQ ID NO: 6636 - DNA, 27 bp; single-stranded, linear
  The letter "N" represents the stem II region of an HH ribozyme.
cccgugcacugaugangaaacucccac

SEQ ID NO: 6637 - DNA, 27 bp; single-stranded, linear
  The letter "N" represents the stem II region of an HH ribozyme.
ucccgugccugaugangaaaacuccca

SEQ ID NO: 6638 - DNA, 27 bp; single-stranded, linear
  The letter "N" represents the stem II region of an HH ribozyme.
gauuugcccugaugangaaaguuucag

SEQ ID NO: 6639 - DNA, 27 bp; single-stranded, linear
  The letter "N" represents the stem II region of an HH ribozyme.
uuccgagccugaugangaaauuugccu

SEQ ID NO: 6640 - DNA, 27 bp; single-stranded, linear
  The letter "N" represents the stem II region of an HH ribozyme.
ccucuucccugaugangaaagcgauuu

SEQ ID NO: 6641 - DNA, 27 bp; single-stranded, linear
  The letter "N" represents the stem II region of an HH ribozyme.
uuucccaacugaugangaaagccccuc

SEQ ID NO: 6642 - DNA, 27 bp; single-stranded, linear
  The letter "N" represents the stem II region of an HH ribozyme.
cuuucccacugaugangaaaagccccu

SEQ ID NO: 6643 - DNA, 27 bp; single-stranded, linear
  The letter "N" represents the stem II region of an HH ribozyme.
acuuuccccugaugangaaaaagcccc

SEQ ID NO: 6644 - DNA, 27 bp; single-stranded, linear
  The letter "N" represents the stem II region of an HH ribozyme.
gcuugaaccugaugangaaacuuuccc

SEQ ID NO: 6645 - DNA, 27 bp; single-stranded, linear
  The letter "N" represents the stem II region of an HH ribozyme.
gaggcuugcugaugangaaacgacuuu

SEQ ID NO: 6646 - DNA, 27 bp; single-stranded, linear
  The letter "N" represents the stem II region of an HH ribozyme.
agaggcuucugaugangaaaacgacuu

SEQ ID NO: 6647 - DNA, 27 bp; single-stranded, linear
  The letter "N" represents the stem II region of an HH ribozyme.
caaaugcacugaugangaaaggcuuga

SEQ ID NO: 6648 - DNA, 27 bp; single-stranded, linear
  The letter "N" represents the stem II region of an HH ribozyme.
uaaugccacugaugangaaaugcagag

SEQ ID NO: 6649 - DNA, 27 bp; single-stranded, linear
  The letter "N" represents the stem II region of an HH ribozyme.
uuaaugcccugaugangaaaaugcaga

SEQ ID NO: 6650 - DNA, 27 bp; single-stranded, linear
  The letter "N" represents the stem II region of an HH ribozyme.
gauuucuucugaugangaaaugccaaa

SEQ ID NO: 6651 - DNA, 27 bp; single-stranded, linear
  The letter "N" represents the stem II region of an HH ribozyme.
ugauuucucugaugangaaaaugccaa

SEQ ID NO: 6652 - DNA, 27 bp; single-stranded, linear
  The letter "N" represents the stem II region of an HH ribozyme.
aggugggucugaugangaaauuucuua

SEQ ID NO: 6653 - DNA, 27 bp; single-stranded, linear
  The letter "N" represents the stem II region of an HH ribozyme.
ccucuuuccugaugangaaacaucuuc

SEQ ID NO: 6654 - DNA, 27 bp; single-stranded, linear
  The letter "N" represents the stem II region of an HH ribozyme.
gagcuuugcugaugangaaacucacug

SEQ ID NO: 6655 - DNA, 27 bp; single-stranded, linear
  The letter "N" represents the stem II region of an HH ribozyme.
ggucaucacugaugangaaagcuuugu

SEQ ID NO: 6656 - DNA, 27 bp; single-stranded, linear
  The letter "N" represents the stem II region of an HH ribozyme.
aagaucuucugaugangaaaguucggu

SEQ ID NO: 6657 - DNA, 27 bp; single-stranded, linear
  The letter "N" represents the stem II region of an HH ribozyme.
ugggucaacugaugangaaaucuugag

SEQ ID NO: 6658 - DNA, 27 bp; single-stranded, linear
  The letter "N" represents the stem II region of an HH ribozyme.
uguggguccugaugangaaagaucuug

SEQ ID NO: 6659 - DNA, 27 bp; single-stranded, linear
  The letter "N" represents the stem II region of an HH ribozyme.
ugauggcccugaugangaaaugugggu

SEQ ID NO: 6660 - DNA, 27 bp; single-stranded, linear
  The letter "N" represents the stem II region of an HH ribozyme.
auucagaucugaugangaaauggccga

SEQ ID NO: 6661 - DNA, 27 bp; single-stranded, linear
  The letter "N" represents the stem II region of an HH ribozyme.
cacauucacugaugangaaaugauggc

SEQ ID NO: 6662 - DNA, 27 bp; single-stranded, linear
  The letter "N" represents the stem II region of an HH ribozyme.
aggagguucugaugangaaaccacauu

SEQ ID NO: 6663 - DNA, 27 bp; single-stranded, linear
  The letter "N" represents the stem II region of an HH ribozyme.
caggaggucugaugangaaaaccacau

SEQ ID NO: 6664 - DNA, 27 bp; single-stranded, linear
  The letter "N" represents the stem II region of an HH ribozyme.
gcucccagcugaugangaaagguuaac

SEQ ID NO: 6665 - DNA, 27 bp; single-stranded, linear
  The letter "N" represents the stem II region of an HH ribozyme.
caccaucacugaugangaaaggcccuc

SEQ ID NO: 6666 - DNA, 27 bp; single-stranded, linear
  The letter "N" represents the stem II region of an HH ribozyme.
uauuccaccugaugangaaaucaccau

SEQ ID NO: 6667 - DNA, 27 bp; single-stranded, linear
  The letter "N" represents the stem II region of an HH ribozyme.
auuugcagcugaugangaaauuccacg

SEQ ID NO: 6668 - DNA, 27 bp; single-stranded, linear
  The letter "N" represents the stem II region of an HH ribozyme.
gguuuccgcugaugangaaauuugcag

SEQ ID NO: 6669 - DNA, 27 bp; single-stranded, linear
  The letter "N" represents the stem II region of an HH ribozyme.
gguaguugcugaugangaaacagguuu

SEQ ID NO: 6670 - DNA, 27 bp; single-stranded, linear
  The letter "N" represents the stem II region of an HH ribozyme.
ucuugaggcugaugangaaaguuggac

SEQ ID NO: 6671 - DNA, 27 bp; single-stranded, linear
  The letter "N" represents the stem II region of an HH ribozyme.
uugcucuucugaugangaaagguaguu

SEQ ID NO: 6672 - DNA, 27 bp; single-stranded, linear
  The letter "N" represents the stem II region of an HH ribozyme.
gacagaaucugaugangaaagucacgu

SEQ ID NO: 6673 - DNA, 27 bp; single-stranded, linear
  The letter "N" represents the stem II region of an HH ribozyme.
agacagaacugaugangaaaagucacg

SEQ ID NO: 6674 - DNA, 27 bp; single-stranded, linear
  The letter "N" represents the stem II region of an HH ribozyme.
ugagacagcugaugangaaauaaguca

SEQ ID NO: 6675 - DNA, 27 bp; single-stranded, linear
  The letter "N" represents the stem II region of an HH ribozyme.
uugagacacugaugangaaaauaaguc

SEQ ID NO: 6676 - DNA, 27 bp; single-stranded, linear
  The letter "N" represents the stem II region of an HH ribozyme.
cuuguugacugaugangaaacagaaua

SEQ ID NO: 6677 - DNA, 27 bp; single-stranded, linear
  The letter "N" represents the stem II region of an HH ribozyme.
uccuuguucugaugangaaagacagaa

SEQ ID NO: 6678 - DNA, 27 bp; single-stranded, linear
  The letter "N" represents the stem II region of an HH ribozyme.
ccauaugccugaugangaaaggcugcg

SEQ ID NO: 6679 - DNA, 27 bp; single-stranded, linear
  The letter "N" represents the stem II region of an HH ribozyme.
gagcuccacugaugangaaaugcaagg

SEQ ID NO: 6680 - DNA, 27 bp; single-stranded, linear
  The letter "N" represents the stem II region of an HH ribozyme.
ucuuucuucugaugangaaagcuccau

SEQ ID NO: 6681 - DNA, 27 bp; single-stranded, linear
  The letter "N" represents the stem II region of an HH ribozyme.
acacuguccugaugangaaaggcgggg

SEQ ID NO: 6682 - DNA, 27 bp; single-stranded, linear
  The letter "N" represents the stem II region of an HH ribozyme.
gagcugcucugaugangaaacacuguc

SEQ ID NO: 6683 - DNA, 27 bp; single-stranded, linear
  The letter "N" represents the stem II region of an HH ribozyme.
ugacacuucugaugangaaagcugcug

SEQ ID NO: 6684 - DNA, 27 bp; single-stranded, linear
  The letter "N" represents the stem II region of an HH ribozyme.
gagcuggucugaugangaaacacuuga

SEQ ID NO: 6685 - DNA, 27 bp; single-stranded, linear
  The letter "N" represents the stem II region of an HH ribozyme.
ggaagcugcugaugangaaagcuggug

SEQ ID NO: 6686 - DNA, 27 bp; single-stranded, linear
  The letter "N" represents the stem II region of an HH ribozyme.
cuucagggcugaugangaaagcuggag

SEQ ID NO: 6687 - DNA, 27 bp; single-stranded, linear
  The letter "N" represents the stem II region of an HH ribozyme.
ucuucaggcugaugangaaaagcugga

SEQ ID NO: 6688 - DNA, 27 bp; single-stranded, linear
  The letter "N" represents the stem II region of an HH ribozyme.
cucacugucugaugangaaauccucgu

SEQ ID NO: 6689 - DNA, 27 bp; single-stranded, linear
  The letter "N" represents the stem II region of an HH ribozyme.
ucucacugcugaugangaaaauccucg

SEQ ID NO: 6690 - DNA, 27 bp; single-stranded, linear
  The letter "N" represents the stem II region of an HH ribozyme.
ugcuuggacugaugangaaaucucacu

SEQ ID NO: 6691 - DNA, 27 bp; single-stranded, linear
  The letter "N" represents the stem II region of an HH ribozyme.
gcugcuugcugaugangaaagaucuca

SEQ ID NO: 6692 - DNA, 27 bp; single-stranded, linear
  The letter "N" represents the stem II region of an HH ribozyme.
uccauggucugaugangaaaggggcug

SEQ ID NO: 6693 - DNA, 27 bp; single-stranded, linear
  The letter "N" represents the stem II region of an HH ribozyme.
cuguaggacugaugangaaaucagguc

SEQ ID NO: 6694 - DNA, 27 bp; single-stranded, linear
  The letter "N" represents the stem II region of an HH ribozyme.
acuguaggcugaugangaaaaucaggu

SEQ ID NO: 6695 - DNA, 27 bp; single-stranded, linear
  The letter "N" represents the stem II region of an HH ribozyme.
aacuguagcugaugangaaaaaucagg

SEQ ID NO: 6696 - DNA, 27 bp; single-stranded, linear
  The letter "N" represents the stem II region of an HH ribozyme.
ggaaacugcugaugangaaaggaaauc

SEQ ID NO: 6697 - DNA, 27 bp; single-stranded, linear
  The letter "N" represents the stem II region of an HH ribozyme.
cacuuggacugaugangaaacuguagg

SEQ ID NO: 6698 - DNA, 27 bp; single-stranded, linear
  The letter "N" represents the stem II region of an HH ribozyme.
ccacuuggcugaugangaaaacuguag

SEQ ID NO: 6699 - DNA, 27 bp; single-stranded, linear
  The letter "N" represents the stem II region of an HH ribozyme.
gccacuugcugaugangaaaaacugua

SEQ ID NO: 6700 - DNA, 27 bp; single-stranded, linear
  The letter "N" represents the stem II region of an HH ribozyme.
aggacagacugaugangaaacuccaug

SEQ ID NO: 6701 - DNA, 27 bp; single-stranded, linear
  The letter "N" represents the stem II region of an HH ribozyme.
gaggacagcugaugangaaaacuccau

SEQ ID NO: 6702 - DNA, 27 bp; single-stranded, linear
  The letter "N" represents the stem II region of an HH ribozyme.
ggaggacacugaugangaaaaacucca

SEQ ID NO: 6703 - DNA, 27 bp; single-stranded, linear
  The letter "N" represents the stem II region of an HH ribozyme.
uucuggagcugaugangaaacagaaac

SEQ ID NO: 6704 - DNA, 27 bp; single-stranded, linear
  The letter "N" represents the stem II region of an HH ribozyme.
acuuucugcugaugangaaaggacaga

SEQ ID NO: 6705 - DNA, 27 bp; single-stranded, linear
  The letter "N" represents the stem II region of an HH ribozyme.
ucccgaugcugaugangaaaugcacuu

SEQ ID NO: 6706 - DNA, 27 bp; single-stranded, linear
  The letter "N" represents the stem II region of an HH ribozyme.
gucccgaucugaugangaaaaugcacu

SEQ ID NO: 6707 - DNA, 27 bp; single-stranded, linear
  The letter "N" represents the stem II region of an HH ribozyme.
cagguccccugaugangaaaugaaugc

SEQ ID NO: 6708 - DNA, 27 bp; single-stranded, linear
  The letter "N" represents the stem II region of an HH ribozyme.
gauaaaagcugaugangaaauguuucu

SEQ ID NO: 6709 - DNA, 27 bp; single-stranded, linear
  The letter "N" represents the stem II region of an HH ribozyme.
ucagauaacugaugangaaaggauguu

SEQ ID NO: 6710 - DNA, 27 bp; single-stranded, linear
  The letter "N" represents the stem II region of an HH ribozyme.
cucagauacugaugangaaaaggaugu

SEQ ID NO: 6711 - DNA, 27 bp; single-stranded, linear
  The letter "N" represents the stem II region of an HH ribozyme.
ucucagaucugaugangaaaaaggaug

SEQ ID NO: 6712 - DNA, 27 bp; single-stranded, linear
  The letter "N" represents the stem II region of an HH ribozyme.
uucucagacugaugangaaaaaaggau

SEQ ID NO: 6713 - DNA, 27 bp; single-stranded, linear
  The letter "N" represents the stem II region of an HH ribozyme.
uguucucacugaugangaaauaaaagg

SEQ ID NO: 6714 - DNA, 27 bp; single-stranded, linear
  The letter "N" represents the stem II region of an HH ribozyme.
aagucgcacugaugangaaaucuucac

SEQ ID NO: 6715 - DNA, 27 bp; single-stranded, linear
  The letter "N" represents the stem II region of an HH ribozyme.
aaagucgccugaugangaaaaucuuca

SEQ ID NO: 6716 - DNA, 27 bp; single-stranded, linear
  The letter "N" represents the stem II region of an HH ribozyme.
ccaggccacugaugangaaagucgcaa

SEQ ID NO: 6717 - DNA, 27 bp; single-stranded, linear
  The letter "N" represents the stem II region of an HH ribozyme.
gccaggcccugaugangaaaagucgca

SEQ ID NO: 6718 - DNA, 27 bp; single-stranded, linear
  The letter "N" represents the stem II region of an HH ribozyme.
cuuauaaacugaugangaaaucccggg

SEQ ID NO: 6719 - DNA, 27 bp; single-stranded, linear
  The letter "N" represents the stem II region of an HH ribozyme.
uucuuauacugaugangaaauaucccg

SEQ ID NO: 6720 - DNA, 27 bp; single-stranded, linear
  The letter "N" represents the stem II region of an HH ribozyme.
guucuuaucugaugangaaaauauccc

SEQ ID NO: 6721 - DNA, 27 bp; single-stranded, linear
  The letter "N" represents the stem II region of an HH ribozyme.
gguucuuacugaugangaaaaauaucc

SEQ ID NO: 6722 - DNA, 27 bp; single-stranded, linear
  The letter "N" represents the stem II region of an HH ribozyme.
aggguucucugaugangaaauaaauau

SEQ ID NO: 6723 - DNA, 27 bp; single-stranded, linear
  The letter "N" represents the stem II region of an HH ribozyme.
ccucacaucugaugangaaaucagggu

SEQ ID NO: 6724 - DNA, 27 bp; single-stranded, linear
  The letter "N" represents the stem II region of an HH ribozyme.
uccucacacugaugangaaaaucaggg

SEQ ID NO: 6725 - DNA, 27 bp; single-stranded, linear
  The letter "N" represents the stem II region of an HH ribozyme.
aagucgagcugaugangaaaucuccuc

SEQ ID NO: 6726 - DNA, 27 bp; single-stranded, linear
  The letter "N" represents the stem II region of an HH ribozyme.
gggaaguccugaugangaaaguaucuc

SEQ ID NO: 6727 - DNA, 27 bp; single-stranded, linear
  The letter "N" represents the stem II region of an HH ribozyme.
uuuaggggcugaugangaaagucgagu

SEQ ID NO: 6728 - DNA, 27 bp; single-stranded, linear
  The letter "N" represents the stem II region of an HH ribozyme.
uuuuagggcugaugangaaaagucgag

SEQ ID NO: 6729 - DNA, 27 bp; single-stranded, linear
  The letter "N" represents the stem II region of an HH ribozyme.
auccauuucugaugangaaaggggaag

SEQ ID NO: 6730 - DNA, 27 bp; single-stranded, linear
  The letter "N" represents the stem II region of an HH ribozyme.
ggauucagcugaugangaaagccaucc

SEQ ID NO: 6731 - DNA, 27 bp; single-stranded, linear
  The letter "N" represents the stem II region of an HH ribozyme.
caaagaugcugaugangaaauucagga

SEQ ID NO: 6732 - DNA, 27 bp; single-stranded, linear
  The letter "N" represents the stem II region of an HH ribozyme.
uugucaaacugaugangaaauggauuc

SEQ ID NO: 6733 - DNA, 27 bp; single-stranded, linear
  The letter "N" represents the stem II region of an HH ribozyme.
ccuugucacugaugangaaagauggau

SEQ ID NO: 6734 - DNA, 27 bp; single-stranded, linear
  The letter "N" represents the stem II region of an HH ribozyme.
accuuguccugaugangaaaagaugga

SEQ ID NO: 6735 - DNA, 27 bp; single-stranded, linear
  The letter "N" represents the stem II region of an HH ribozyme.
gugcuguacugaugangaaaccuuguc

SEQ ID NO: 6736 - DNA, 27 bp; single-stranded, linear
  The letter "N" represents the stem II region of an HH ribozyme.
uggugcugcugaugangaaagaccuug

SEQ ID NO: 6737 - DNA, 27 bp; single-stranded, linear
  The letter "N" represents the stem II region of an HH ribozyme.
cgccauagcugaugangaaaccacaca

SEQ ID NO: 6738 - DNA, 27 bp; single-stranded, linear
  The letter "N" represents the stem II region of an HH ribozyme.
acacgccacugaugangaaaggaccac

SEQ ID NO: 6739 - DNA, 27 bp; single-stranded, linear
  The letter "N" represents the stem II region of an HH ribozyme.
cccacagccugaugangaaacacgcca

SEQ ID NO: 6740 - DNA, 27 bp; single-stranded, linear
  The letter "N" represents the stem II region of an HH ribozyme.
aaggagaacugaugangaaaucuccca

SEQ ID NO: 6741 - DNA, 27 bp; single-stranded, linear
  The letter "N" represents the stem II region of an HH ribozyme.
cuaaggagcugaugangaaagaucucc

SEQ ID NO: 6742 - DNA, 27 bp; single-stranded, linear
  The letter "N" represents the stem II region of an HH ribozyme.
ccuaaggacugaugangaaaagaucuc

SEQ ID NO: 6743 - DNA, 27 bp; single-stranded, linear
  The letter "N" represents the stem II region of an HH ribozyme.
ccccuaagcugaugangaaagaagauc

SEQ ID NO: 6744 - DNA, 27 bp; single-stranded, linear
  The letter "N" represents the stem II region of an HH ribozyme.
aacccccucugaugangaaaggagaag

SEQ ID NO: 6745 - DNA, 27 bp; single-stranded, linear
  The letter "N" represents the stem II region of an HH ribozyme.
gaaccccccugaugangaaaaggagaa

SEQ ID NO: 6746 - DNA, 27 bp; single-stranded, linear
  The letter "N" represents the stem II region of an HH ribozyme.
guauggagcugaugangaaacccccua

SEQ ID NO: 6747 - DNA, 27 bp; single-stranded, linear
  The letter "N" represents the stem II region of an HH ribozyme.
gguauggacugaugangaaaacccccu

SEQ ID NO: 6748 - DNA, 27 bp; single-stranded, linear
  The letter "N" represents the stem II region of an HH ribozyme.
uggguaugcugaugangaaagaacccc

SEQ ID NO: 6749 - DNA, 27 bp; single-stranded, linear
  The letter "N" represents the stem II region of an HH ribozyme.
cuccugggcugaugangaaauggagaa

SEQ ID NO: 6750 - DNA, 27 bp; single-stranded, linear
  The letter "N" represents the stem II region of an HH ribozyme.
ggcugcagcugaugangaaagucuuca

SEQ ID NO: 6751 - DNA, 27 bp; single-stranded, linear
  The letter "N" represents the stem II region of an HH ribozyme.
cggcugcacugaugangaaaagucuuc

SEQ ID NO: 6752 - DNA, 27 bp; single-stranded, linear
  The letter "N" represents the stem II region of an HH ribozyme.
guguggcacugaugangaaacuccggg

SEQ ID NO: 6753 - DNA, 27 bp; single-stranded, linear
  The letter "N" represents the stem II region of an HH ribozyme.
auuugguacugaugangaaauuucagg

SEQ ID NO: 6754 - DNA, 27 bp; single-stranded, linear
  The letter "N" represents the stem II region of an HH ribozyme.
ugauuuggcugaugangaaagauuuca

SEQ ID NO: 6755 - DNA, 27 bp; single-stranded, linear
  The letter "N" represents the stem II region of an HH ribozyme.
uccaacaucugaugangaaauuuggua

SEQ ID NO: 6756 - DNA, 27 bp; single-stranded, linear
  The letter "N" represents the stem II region of an HH ribozyme.
agcaaucccugaugangaaacaugauu

SEQ ID NO: 6757 - DNA, 27 bp; single-stranded, linear
  The letter "N" represents the stem II region of an HH ribozyme.
gugccagccugaugangaaauccaaca

SEQ ID NO: 6758 - DNA, 27 bp; single-stranded, linear
  The letter "N" represents the stem II region of an HH ribozyme.
guucagcacugaugangaaaccggggc

SEQ ID NO: 6759 - DNA, 27 bp; single-stranded, linear
  The letter "N" represents the stem II region of an HH ribozyme.
aguucagccugaugangaaaaccgggg

SEQ ID NO: 6760 - DNA, 27 bp; single-stranded, linear
  The letter "N" represents the stem II region of an HH ribozyme.
uucuccaccugaugangaaaguucagc

SEQ ID NO: 6761 - DNA, 27 bp; single-stranded, linear
  The letter "N" represents the stem II region of an HH ribozyme.
aggucacccugaugangaaaguuucuc

SEQ ID NO: 6762 - DNA, 27 bp; single-stranded, linear
  The letter "N" represents the stem II region of an HH ribozyme.
uuggcuugcugaugangaaagcagguc

SEQ ID NO: 6763 - DNA, 27 bp; single-stranded, linear
  The letter "N" represents the stem II region of an HH ribozyme.
guuggcuucugaugangaaaagcaggu

SEQ ID NO: 6764 - DNA, 27 bp; single-stranded, linear
  The letter "N" represents the stem II region of an HH ribozyme.
uccuguugcugaugangaaacguuggc

SEQ ID NO: 6765 - DNA, 27 bp; single-stranded, linear
  The letter "N" represents the stem II region of an HH ribozyme.
ggggaugucugaugangaaaucuuucc

SEQ ID NO: 6766 - DNA, 27 bp; single-stranded, linear
  The letter "N" represents the stem II region of an HH ribozyme.
gggggaugcugaugangaaaaucuuuc

SEQ ID NO: 6767 - DNA, 27 bp; single-stranded, linear
  The letter "N" represents the stem II region of an HH ribozyme.
uugaggggcugaugangaaauguaauc

SEQ ID NO: 6768 - DNA, 27 bp; single-stranded, linear
  The letter "N" represents the stem II region of an HH ribozyme.
auggcauucugaugangaaagggggau

SEQ ID NO: 6769 - DNA, 27 bp; single-stranded, linear
  The letter "N" represents the stem II region of an HH ribozyme.
cuagucagcugaugangaaauggcauu

SEQ ID NO: 6770 - DNA, 27 bp; single-stranded, linear
  The letter "N" represents the stem II region of an HH ribozyme.
acuguuuccugaugangaaagucagua

SEQ ID NO: 6771 - DNA, 27 bp; single-stranded, linear
  The letter "N" represents the stem II region of an HH ribozyme.
ugugaagccugaugangaaacuguuuc

SEQ ID NO: 6772 - DNA, 27 bp; single-stranded, linear
  The letter "N" represents the stem II region of an HH ribozyme.
aguaugugcugaugangaaagcuacug

SEQ ID NO: 6773 - DNA, 27 bp; single-stranded, linear
  The letter "N" represents the stem II region of an HH ribozyme.
gaguaugucugaugangaaaagcuacu

SEQ ID NO: 6774 - DNA, 27 bp; single-stranded, linear
  The letter "N" represents the stem II region of an HH ribozyme.
gggucgagcugaugangaaaugugaag

SEQ ID NO: 6775 - DNA, 27 bp; single-stranded, linear
  The letter "N" represents the stem II region of an HH ribozyme.
uggggguccugaugangaaaguaugug

SEQ ID NO: 6776 - DNA, 27 bp; single-stranded, linear
  The letter "N" represents the stem II region of an HH ribozyme.
ccucagagcugaugangaaaggugggg

SEQ ID NO: 6777 - DNA, 27 bp; single-stranded, linear
  The letter "N" represents the stem II region of an HH ribozyme.
uccucagacugaugangaaaagguggg

SEQ ID NO: 6778 - DNA, 27 bp; single-stranded, linear
  The letter "N" represents the stem II region of an HH ribozyme.
gguccucacugaugangaaagaaggug

SEQ ID NO: 6779 - DNA, 27 bp; single-stranded, linear
  The letter "N" represents the stem II region of an HH ribozyme.
uccuugaacugaugangaaagguccuc

SEQ ID NO: 6780 - DNA, 27 bp; single-stranded, linear
  The letter "N" represents the stem II region of an HH ribozyme.
guccuugacugaugangaaaagguccu

SEQ ID NO: 6781 - DNA, 27 bp; single-stranded, linear
  The letter "N" represents the stem II region of an HH ribozyme.
cguccuugcugaugangaaaaaggucc

SEQ ID NO: 6782 - DNA, 27 bp; single-stranded, linear
  The letter "N" represents the stem II region of an HH ribozyme.
ccguccuucugaugangaaaaaagguc

SEQ ID NO: 6783 - DNA, 27 bp; single-stranded, linear
  The letter "N" represents the stem II region of an HH ribozyme.
gaucugcacugaugangaaagccgucc

SEQ ID NO: 6784 - DNA, 27 bp; single-stranded, linear
  The letter "N" represents the stem II region of an HH ribozyme.
ggaucugccugaugangaaaagccguc

SEQ ID NO: 6785 - DNA, 27 bp; single-stranded, linear
  The letter "N" represents the stem II region of an HH ribozyme.
aaaaugugcugaugangaaaucugcaa

SEQ ID NO: 6786 - DNA, 27 bp; single-stranded, linear
  The letter "N" represents the stem II region of an HH ribozyme.
ggaaugaacugaugangaaauguggau

SEQ ID NO: 6787 - DNA, 27 bp; single-stranded, linear
  The letter "N" represents the stem II region of an HH ribozyme.
cggaaugacugaugangaaaaugugga

SEQ ID NO: 6788 - DNA, 27 bp; single-stranded, linear
  The letter "N" represents the stem II region of an HH ribozyme.
ccggaaugcugaugangaaaaaugugg

SEQ ID NO: 6789 - DNA, 27 bp; single-stranded, linear
  The letter "N" represents the stem II region of an HH ribozyme.
uccggaaucugaugangaaaaaaugug

SEQ ID NO: 6790 - DNA, 27 bp; single-stranded, linear
  The letter "N" represents the stem II region of an HH ribozyme.
gcuuccggcugaugangaaaugaaaau

SEQ ID NO: 6791 - DNA, 27 bp; single-stranded, linear
  The letter "N" represents the stem II region of an HH ribozyme.
agcuuccgcugaugangaaaaugaaaa

SEQ ID NO: 6792 - DNA, 27 bp; single-stranded, linear
  The letter "N" represents the stem II region of an HH ribozyme.
caucaucacugaugangaaagcuuccg

SEQ ID NO: 6793 - DNA, 27 bp; single-stranded, linear
  The letter "N" represents the stem II region of an HH ribozyme.
cguuuacacugaugangaaaucucaca

SEQ ID NO: 6794 - DNA, 27 bp; single-stranded, linear
  The letter "N" represents the stem II region of an HH ribozyme.
aaagcguucugaugangaaacauaucu

SEQ ID NO: 6795 - DNA, 27 bp; single-stranded, linear
  The letter "N" represents the stem II region of an HH ribozyme.
gaauuugacugaugangaaagcguuua

SEQ ID NO: 6796 - DNA, 27 bp; single-stranded, linear
  The letter "N" represents the stem II region of an HH ribozyme.
ugaauuugcugaugangaaaagcguuu

SEQ ID NO: 6797 - DNA, 27 bp; single-stranded, linear
  The letter "N" represents the stem II region of an HH ribozyme.
augaauuucugaugangaaaaagcguu

SEQ ID NO: 6798 - DNA, 27 bp; single-stranded, linear
  The letter "N" represents the stem II region of an HH ribozyme.
ggcucaugcugaugangaaauuugaaa

SEQ ID NO: 6799 - DNA, 27 bp; single-stranded, linear
  The letter "N" represents the stem II region of an HH ribozyme.
aggcucaucugaugangaaaauuugaa

SEQ ID NO: 6800 - DNA, 27 bp; single-stranded, linear
  The letter "N" represents the stem II region of an HH ribozyme.
aagguuuucugaugangaaauucuuuc

SEQ ID NO: 6801 - DNA, 27 bp; single-stranded, linear
  The letter "N" represents the stem II region of an HH ribozyme.
gcuccucacugaugangaaagguuuug

SEQ ID NO: 6802 - DNA, 27 bp; single-stranded, linear
  The letter "N" represents the stem II region of an HH ribozyme.
agcuccuccugaugangaaaagguuuu

SEQ ID NO: 6803 - DNA, 27 bp; single-stranded, linear
  The letter "N" represents the stem II region of an HH ribozyme.
uucggugacugaugangaaagcuccuc

SEQ ID NO: 6804 - DNA, 27 bp; single-stranded, linear
  The letter "N" represents the stem II region of an HH ribozyme.
guucggugcugaugangaaaagcuccu

SEQ ID NO: 6805 - DNA, 27 bp; single-stranded, linear
  The letter "N" represents the stem II region of an HH ribozyme.
aguucggucugaugangaaaaagcucc

SEQ ID NO: 6806 - DNA, 27 bp; single-stranded, linear
  The letter "N" represents the stem II region of an HH ribozyme.
uggaggugcugaugangaaaguucggu

SEQ ID NO: 6807 - DNA, 27 bp; single-stranded, linear
  The letter "N" represents the stem II region of an HH ribozyme.
caaacaugcugaugangaaagguggag

SEQ ID NO: 6808 - DNA, 27 bp; single-stranded, linear
  The letter "N" represents the stem II region of an HH ribozyme.
aguccucacugaugangaaacauggag

SEQ ID NO: 6809 - DNA, 27 bp; single-stranded, linear
  The letter "N" represents the stem II region of an HH ribozyme.
uaguccuccugaugangaaaacaugga

SEQ ID NO: 6810 - DNA, 27 bp; single-stranded, linear
  The letter "N" represents the stem II region of an HH ribozyme.
ccagcugacugaugangaaaguccuca

SEQ ID NO: 6811 - DNA, 27 bp; single-stranded, linear
  The letter "N" represents the stem II region of an HH ribozyme.
guccagcucugaugangaaauaguccu

SEQ ID NO: 6812 - DNA, 27 bp; single-stranded, linear
  The letter "N" represents the stem II region of an HH ribozyme.
cagagugccugaugangaaagugucca

SEQ ID NO: 6813 - DNA, 27 bp; single-stranded, linear
  The letter "N" represents the stem II region of an HH ribozyme.
gcccagcacugaugangaaagugcuag

SEQ ID NO: 6814 - DNA, 27 bp; single-stranded, linear
  The letter "N" represents the stem II region of an HH ribozyme.
gcaaggggcugaugangaaagcccagc

SEQ ID NO: 6815 - DNA, 27 bp; single-stranded, linear
  The letter "N" represents the stem II region of an HH ribozyme.
gcuucagccugaugangaaagggggag

SEQ ID NO: 6816 - DNA, 27 bp; single-stranded, linear
  The letter "N" represents the stem II region of an HH ribozyme.
uccaggugcugaugangaaaccgcuuc

SEQ ID NO: 6817 - DNA, 27 bp; single-stranded, linear
  The letter "N" represents the stem II region of an HH ribozyme.
guccaggucugaugangaaaaccgcuu

SEQ ID NO: 6818 - DNA, 27 bp; single-stranded, linear
  The letter "N" represents the stem II region of an HH ribozyme.
ucuucaugcugaugangaaaggccuug

SEQ ID NO: 6819 - DNA, 27 bp; single-stranded, linear
  The letter "N" represents the stem II region of an HH ribozyme.
cucaaguccugaugangaaaucuucau

SEQ ID NO: 6820 - DNA, 27 bp; single-stranded, linear
  The letter "N" represents the stem II region of an HH ribozyme.
cuauucuccugaugangaaagucuauc

SEQ ID NO: 6821 - DNA, 27 bp; single-stranded, linear
  The letter "N" represents the stem II region of an HH ribozyme.
uuacucgccugaugangaaauucucaa

SEQ ID NO: 6822 - DNA, 27 bp; single-stranded, linear
  The letter "N" represents the stem II region of an HH ribozyme.
cuugcuuucugaugangaaacucgcua

SEQ ID NO: 6823 - DNA, 27 bp; single-stranded, linear
  The letter "N" represents the stem II region of an HH ribozyme.
agaucggacugaugangaaagucccgc

SEQ ID NO: 6824 - DNA, 27 bp; single-stranded, linear
  The letter "N" represents the stem II region of an HH ribozyme.
cagaucggcugaugangaaaagucccg

SEQ ID NO: 6825 - DNA, 27 bp; single-stranded, linear
  The letter "N" represents the stem II region of an HH ribozyme.
gcagaucgcugaugangaaaaaguccc

SEQ ID NO: 6826 - DNA, 27 bp; single-stranded, linear
  The letter "N" represents the stem II region of an HH ribozyme.
ccucggcacugaugangaaaucggaaa

SEQ ID NO: 6827 - DNA, 27 bp; single-stranded, linear
  The letter "N" represents the stem II region of an HH ribozyme.
agaagcagcugaugangaaagcugggc

SEQ ID NO: 6828 - DNA, 27 bp; single-stranded, linear
  The letter "N" represents the stem II region of an HH ribozyme.
gagaagcacugaugangaaaagcuggg

SEQ ID NO: 6829 - DNA, 27 bp; single-stranded, linear
  The letter "N" represents the stem II region of an HH ribozyme.
agcuggagcugaugangaaagcagaag

SEQ ID NO: 6830 - DNA, 27 bp; single-stranded, linear
  The letter "N" represents the stem II region of an HH ribozyme.
cagcuggacugaugangaaaagcagaa

SEQ ID NO: 6831 - DNA, 27 bp; single-stranded, linear
  The letter "N" represents the stem II region of an HH ribozyme.
cacagcugcugaugangaaagaagcag

SEQ ID NO: 6832 - DNA, 27 bp; single-stranded, linear
  The letter "N" represents the stem II region of an HH ribozyme.
acgggccucugaugangaaauguggcc

SEQ ID NO: 6833 - DNA, 27 bp; single-stranded, linear
  The letter "N" represents the stem II region of an HH ribozyme.
ccagcucacugaugangaaauucaucg

SEQ ID NO: 6834 - DNA, 27 bp; single-stranded, linear
  The letter "N" represents the stem II region of an HH ribozyme.
aacagcagcugaugangaaacuccuuu

SEQ ID NO: 6835 - DNA, 27 bp; single-stranded, linear
  The letter "N" represents the stem II region of an HH ribozyme.
ggguggagcugaugangaaacagcagg

SEQ ID NO: 6836 - DNA, 27 bp; single-stranded, linear
  The letter "N" represents the stem II region of an HH ribozyme.
gggguggacugaugangaaaacagcag

SEQ ID NO: 6837 - DNA, 27 bp; single-stranded, linear
  The letter "N" represents the stem II region of an HH ribozyme.
ugggggugcugaugangaaagaacagc

SEQ ID NO: 6838 - DNA, 27 bp; single-stranded, linear
  The letter "N" represents the stem II region of an HH ribozyme.
cggaguugcugaugangaaagucuggg

SEQ ID NO: 6839 - DNA, 27 bp; single-stranded, linear
  The letter "N" represents the stem II region of an HH ribozyme.
acaccacgcugaugangaaaguuguag

SEQ ID NO: 6840 - DNA, 27 bp; single-stranded, linear
  The letter "N" represents the stem II region of an HH ribozyme.
aggaguaccugaugangaaacaccacg

SEQ ID NO: 6841 - DNA, 27 bp; single-stranded, linear
  The letter "N" represents the stem II region of an HH ribozyme.
gggaggagcugaugangaaacaacacc

SEQ ID NO: 6842 - DNA, 27 bp; single-stranded, linear
  The letter "N" represents the stem II region of an HH ribozyme.
gcggggagcugaugangaaaguacaac

SEQ ID NO: 6843 - DNA, 27 bp; single-stranded, linear
  The letter "N" represents the stem II region of an HH ribozyme.
cgggcgggcugaugangaaaggaguac

SEQ ID NO: 6844 - DNA, 27 bp; single-stranded, linear
  The letter "N" represents the stem II region of an HH ribozyme.
agaagcuucugaugangaaaggcgggc

SEQ ID NO: 6845 - DNA, 27 bp; single-stranded, linear
  The letter "N" represents the stem II region of an HH ribozyme.
cuggugagcugaugangaaagcuuuag

SEQ ID NO: 6846 - DNA, 27 bp; single-stranded, linear
  The letter "N" represents the stem II region of an HH ribozyme.
gcuggugacugaugangaaaagcuuua

SEQ ID NO: 6847 - DNA, 27 bp; single-stranded, linear
  The letter "N" represents the stem II region of an HH ribozyme.
gggcuggucugaugangaaagaagcuu

SEQ ID NO: 6848 - DNA, 27 bp; single-stranded, linear
  The letter "N" represents the stem II region of an HH ribozyme.
auguauaacugaugangaaacugucag

SEQ ID NO: 6849 - DNA, 27 bp; single-stranded, linear
  The letter "N" represents the stem II region of an HH ribozyme.
agauguaucugaugangaaauacuguc

SEQ ID NO: 6850 - DNA, 27 bp; single-stranded, linear
  The letter "N" represents the stem II region of an HH ribozyme.
uagauguacugaugangaaaauacugu

SEQ ID NO: 6851 - DNA, 27 bp; single-stranded, linear
  The letter "N" represents the stem II region of an HH ribozyme.
cauagaugcugaugangaaauaauacu

SEQ ID NO: 6852 - DNA, 27 bp; single-stranded, linear
  The letter "N" represents the stem II region of an HH ribozyme.
aacucauacugaugangaaauguauaa

SEQ ID NO: 6853 - DNA, 27 bp; single-stranded, linear
  The letter "N" represents the stem II region of an HH ribozyme.
uaaacucacugaugangaaagauguau

SEQ ID NO: 6854 - DNA, 27 bp; single-stranded, linear
  The letter "N" represents the stem II region of an HH ribozyme.
uagguguacugaugangaaacucauag

SEQ ID NO: 6855 - DNA, 27 bp; single-stranded, linear
  The letter "N" represents the stem II region of an HH ribozyme.
auaggugucugaugangaaaacucaua

SEQ ID NO: 6856 - DNA, 27 bp; single-stranded, linear
  The letter "N" represents the stem II region of an HH ribozyme.
aauaggugcugaugangaaaaacucau

SEQ ID NO: 6857 - DNA, 27 bp; single-stranded, linear
  The letter "N" represents the stem II region of an HH ribozyme.
gagcggaacugaugangaaagguguaa

SEQ ID NO: 6858 - DNA, 27 bp; single-stranded, linear
  The letter "N" represents the stem II region of an HH ribozyme.
uggagcggcugaugangaaauaggugu

SEQ ID NO: 6859 - DNA, 27 bp; single-stranded, linear
  The letter "N" represents the stem II region of an HH ribozyme.
guggagcgcugaugangaaaauaggug

SEQ ID NO: 6860 - DNA, 27 bp; single-stranded, linear
  The letter "N" represents the stem II region of an HH ribozyme.
cuccugugcugaugangaaagcggaau

SEQ ID NO: 6861 - DNA, 27 bp; single-stranded, linear
  The letter "N" represents the stem II region of an HH ribozyme.
gucacgaacugaugangaaagcagcug

SEQ ID NO: 6862 - DNA, 27 bp; single-stranded, linear
  The letter "N" represents the stem II region of an HH ribozyme.
ggucacgacugaugangaaaagcagcu

SEQ ID NO: 6863 - DNA, 27 bp; single-stranded, linear
  The letter "N" represents the stem II region of an HH ribozyme.
aggucacgcugaugangaaaaagcagc

SEQ ID NO: 6864 - DNA, 27 bp; single-stranded, linear
  The letter "N" represents the stem II region of an HH ribozyme.
aaggucaccugaugangaaaaaagcag

SEQ ID NO: 6865 - DNA, 27 bp; single-stranded, linear
  The letter "N" represents the stem II region of an HH ribozyme.
cacgauuacugaugangaaaggucacg

SEQ ID NO: 6866 - DNA, 27 bp; single-stranded, linear
  The letter "N" represents the stem II region of an HH ribozyme.
gcacgauucugaugangaaaaggucac

SEQ ID NO: 6867 - DNA, 27 bp; single-stranded, linear
  The letter "N" represents the stem II region of an HH ribozyme.
agcacgaucugaugangaaaaagguca

SEQ ID NO: 6868 - DNA, 27 bp; single-stranded, linear
  The letter "N" represents the stem II region of an HH ribozyme.
aaaagcaccugaugangaaauuaaagg

SEQ ID NO: 6869 - DNA, 27 bp; single-stranded, linear
  The letter "N" represents the stem II region of an HH ribozyme.
aaacaaaacugaugangaaagcacgau

SEQ ID NO: 6870 - DNA, 27 bp; single-stranded, linear
  The letter "N" represents the stem II region of an HH ribozyme.
aaaacaaacugaugangaaaagcacga

SEQ ID NO: 6871 - DNA, 27 bp; single-stranded, linear
  The letter "N" represents the stem II region of an HH ribozyme.
aaaaacaacugaugangaaaaagcacg

SEQ ID NO: 6872 - DNA, 27 bp; single-stranded, linear
  The letter "N" represents the stem II region of an HH ribozyme.
aaaaaacacugaugangaaaaaagcac

SEQ ID NO: 6873 - DNA, 27 bp; single-stranded, linear
  The letter "N" represents the stem II region of an HH ribozyme.
caaaaaaccugaugangaaaaaaagca

SEQ ID NO: 6874 - DNA, 27 bp; single-stranded, linear
  The letter "N" represents the stem II region of an HH ribozyme.
aaacaaaacugaugangaaacaaaaaa

SEQ ID NO: 6875 - DNA, 27 bp; single-stranded, linear
  The letter "N" represents the stem II region of an HH ribozyme.
aaaacaaacugaugangaaaacaaaaa

SEQ ID NO: 6876 - DNA, 27 bp; single-stranded, linear
  The letter "N" represents the stem II region of an HH ribozyme.
caaaacaacugaugangaaaaacaaaa

SEQ ID NO: 6877 - DNA, 27 bp; single-stranded, linear
  The letter "N" represents the stem II region of an HH ribozyme.
acaaaacacugaugangaaaaaacaaa

SEQ ID NO: 6878 - DNA, 27 bp; single-stranded, linear
  The letter "N" represents the stem II region of an HH ribozyme.
aacaaaaccugaugangaaaaaaacaa

SEQ ID NO: 6879 - DNA, 27 bp; single-stranded, linear
  The letter "N" represents the stem II region of an HH ribozyme.
acaaacaacugaugangaaacaaaaaa

SEQ ID NO: 6880 - DNA, 27 bp; single-stranded, linear
  The letter "N" represents the stem II region of an HH ribozyme.
aacaaacacugaugangaaaacaaaaa

SEQ ID NO: 6881 - DNA, 27 bp; single-stranded, linear
  The letter "N" represents the stem II region of an HH ribozyme.
caacaaaccugaugangaaaaacaaaa

SEQ ID NO: 6882 - DNA, 27 bp; single-stranded, linear
  The letter "N" represents the stem II region of an HH ribozyme.
caacaacacugaugangaaacaaaaca

SEQ ID NO: 6883 - DNA, 27 bp; single-stranded, linear
  The letter "N" represents the stem II region of an HH ribozyme.
gcaacaaccugaugangaaaacaaaac

SEQ ID NO: 6884 - DNA, 27 bp; single-stranded, linear
  The letter "N" represents the stem II region of an HH ribozyme.
acagcaaccugaugangaaacaaacaa

SEQ ID NO: 6885 - DNA, 27 bp; single-stranded, linear
  The letter "N" represents the stem II region of an HH ribozyme.
aaaacagccugaugangaaacaacaaa

SEQ ID NO: 6886 - DNA, 27 bp; single-stranded, linear
  The letter "N" represents the stem II region of an HH ribozyme.
uuagucaacugaugangaaacagcaac

SEQ ID NO: 6887 - DNA, 27 bp; single-stranded, linear
  The letter "N" represents the stem II region of an HH ribozyme.
guuagucacugaugangaaaacagcaa

SEQ ID NO: 6888 - DNA, 27 bp; single-stranded, linear
  The letter "N" represents the stem II region of an HH ribozyme.
uguuaguccugaugangaaaaacagca

SEQ ID NO: 6889 - DNA, 27 bp; single-stranded, linear
  The letter "N" represents the stem II region of an HH ribozyme.
auucuugucugaugangaaagucaaaa

SEQ ID NO: 6890 - DNA, 27 bp; single-stranded, linear
  The letter "N" represents the stem II region of an HH ribozyme.
acuggggucugaugangaaacauucuu

SEQ ID NO: 6891 - DNA, 27 bp; single-stranded, linear
  The letter "N" represents the stem II region of an HH ribozyme.
acgucacucugaugangaaacuggggu

SEQ ID NO: 6892 - DNA, 27 bp; single-stranded, linear
  The letter "N" represents the stem II region of an HH ribozyme.
cacgucaccugaugangaaaacugggg

SEQ ID NO: 6893 - DNA, 27 bp; single-stranded, linear
  The letter "N" represents the stem II region of an HH ribozyme.
aacaauagcugaugangaaauucuuca

SEQ ID NO: 6894 - DNA, 27 bp; single-stranded, linear
  The letter "N" represents the stem II region of an HH ribozyme.
ucuaacaacugaugangaaaguauucu

SEQ ID NO: 6895 - DNA, 27 bp; single-stranded, linear
  The letter "N" represents the stem II region of an HH ribozyme.
ucucuaaccugaugangaaauaguauu

SEQ ID NO: 6896 - DNA, 27 bp; single-stranded, linear
  The letter "N" represents the stem II region of an HH ribozyme.
auuucucucugaugangaaacaauagu

SEQ ID NO: 6897 - DNA, 27 bp; single-stranded, linear
  The letter "N" represents the stem II region of an HH ribozyme.
gauuucuccugaugangaaaacaauag

SEQ ID NO: 6898 - DNA, 27 bp; single-stranded, linear
  The letter "N" represents the stem II region of an HH ribozyme.
gcggggggcugaugangaaauuucucu

SEQ ID NO: 6899 - DNA, 27 bp; single-stranded, linear
  The letter "N" represents the stem II region of an HH ribozyme.
guuacccucugaugangaaaggcuuug

SEQ ID NO: 6900 - DNA, 27 bp; single-stranded, linear
  The letter "N" represents the stem II region of an HH ribozyme.
guccaggucugaugangaaacccugag

SEQ ID NO: 6901 - DNA, 27 bp; single-stranded, linear
  The letter "N" represents the stem II region of an HH ribozyme.
ggucgccacugaugangaaaggcaccu

SEQ ID NO: 6902 - DNA, 27 bp; single-stranded, linear
  The letter "N" represents the stem II region of an HH ribozyme.
gcugcaggcugaugangaaaggguggg

SEQ ID NO: 6903 - DNA, 27 bp; single-stranded, linear
  The letter "N" represents the stem II region of an HH ribozyme.
acugccuccugaugangaaagucccac

SEQ ID NO: 6904 - DNA, 27 bp; single-stranded, linear
  The letter "N" represents the stem II region of an HH ribozyme.
aaugggcucugaugangaaacugccuc

SEQ ID NO: 6905 - DNA, 27 bp; single-stranded, linear
  The letter "N" represents the stem II region of an HH ribozyme.
caugagcucugaugangaaaugggcuu

SEQ ID NO: 6906 - DNA, 27 bp; single-stranded, linear
  The letter "N" represents the stem II region of an HH ribozyme.
ccaugagccugaugangaaaaugggcu

SEQ ID NO: 6907 - DNA, 27 bp; single-stranded, linear
  The letter "N" represents the stem II region of an HH ribozyme.
gcagccaucugaugangaaagcuaaug

SEQ ID NO: 6908 - DNA, 27 bp; single-stranded, linear
  The letter "N" represents the stem II region of an HH ribozyme.
gagagacacugaugangaaagcagguc

SEQ ID NO: 6909 - DNA, 27 bp; single-stranded, linear
  The letter "N" represents the stem II region of an HH ribozyme.
auaagagacugaugangaaacagagca

SEQ ID NO: 6910 - DNA, 27 bp; single-stranded, linear
  The letter "N" represents the stem II region of an HH ribozyme.
ccauaagacugaugangaaagacagag

SEQ ID NO: 6911 - DNA, 27 bp; single-stranded, linear
  The letter "N" represents the stem II region of an HH ribozyme.
cuccauaacugaugangaaagagacag

SEQ ID NO: 6912 - DNA, 27 bp; single-stranded, linear
  The letter "N" represents the stem II region of an HH ribozyme.
uccuccaucugaugangaaagagagac

SEQ ID NO: 6913 - DNA, 27 bp; single-stranded, linear
  The letter "N" represents the stem II region of an HH ribozyme.
uuccuccacugaugangaaaagagaga

SEQ ID NO: 6914 - DNA, 27 bp; single-stranded, linear
  The letter "N" represents the stem II region of an HH ribozyme.
gcaucccacugaugangaaagccuuuu

SEQ ID NO: 6915 - DNA, 27 bp; single-stranded, linear
  The letter "N" represents the stem II region of an HH ribozyme.
cgcauccccugaugangaaaagccuuu

SEQ ID NO: 6916 - DNA, 27 bp; single-stranded, linear
  The letter "N" represents the stem II region of an HH ribozyme.
acaggacgcugaugangaaacgcaucc

SEQ ID NO: 6917 - DNA, 27 bp; single-stranded, linear
  The letter "N" represents the stem II region of an HH ribozyme.
cuccacagcugaugangaaacggacgc

SEQ ID NO: 6918 - DNA, 27 bp; single-stranded, linear
  The letter "N" represents the stem II region of an HH ribozyme.
gcauagcgcugaugangaaagcccccu

SEQ ID NO: 6919 - DNA, 27 bp; single-stranded, linear
  The letter "N" represents the stem II region of an HH ribozyme.
aaguggcacugaugangaaagcggagc

SEQ ID NO: 6920 - DNA, 27 bp; single-stranded, linear
  The letter "N" represents the stem II region of an HH ribozyme.
agucacugcugaugangaaaguggcau

SEQ ID NO: 6921 - DNA, 27 bp; single-stranded, linear
  The letter "N" represents the stem II region of an HH ribozyme.
aagucacucugaugangaaaaguggca

SEQ ID NO: 6922 - DNA, 27 bp; single-stranded, linear
  The letter "N" represents the stem II region of an HH ribozyme.
ggagugagcugaugangaaagucacug

SEQ ID NO: 6923 - DNA, 27 bp; single-stranded, linear
  The letter "N" represents the stem II region of an HH ribozyme.
aggagugacugaugangaaaagucacu

SEQ ID NO: 6924 - DNA, 27 bp; single-stranded, linear
  The letter "N" represents the stem II region of an HH ribozyme.
ccaggagucugaugangaaagaaguca

SEQ ID NO: 6925 - DNA, 27 bp; single-stranded, linear
  The letter "N" represents the stem II region of an HH ribozyme.
gaggccagcugaugangaaagugagaa

SEQ ID NO: 6926 - DNA, 27 bp; single-stranded, linear
  The letter "N" represents the stem II region of an HH ribozyme.
aaacagcgcugaugangaaaggccagg

SEQ ID NO: 6927 - DNA, 27 bp; single-stranded, linear
  The letter "N" represents the stem II region of an HH ribozyme.
gggcccgacugaugangaaacagcgga

SEQ ID NO: 6928 - DNA, 27 bp; single-stranded, linear
  The letter "N" represents the stem II region of an HH ribozyme.
ggggcccgcugaugangaaaacagcgg

SEQ ID NO: 6929 - DNA, 27 bp; single-stranded, linear
  The letter "N" represents the stem II region of an HH ribozyme.
gggggccccugaugangaaaaacagcg

SEQ ID NO: 6930 - DNA, 27 bp; single-stranded, linear
  The letter "N" represents the stem II region of an HH ribozyme.
ccucuuggcugaugangaaagggggcc

SEQ ID NO: 6931 - DNA, 27 bp; single-stranded, linear
  The letter "N" represents the stem II region of an HH ribozyme.
accucuugcugaugangaaaagggggc

SEQ ID NO: 6932 - DNA, 27 bp; single-stranded, linear
  The letter "N" represents the stem II region of an HH ribozyme.
ugcucugacugaugangaaaccucuug

SEQ ID NO: 6933 - DNA, 27 bp; single-stranded, linear
  The letter "N" represents the stem II region of an HH ribozyme.
ucugcucucugaugangaaauaccucu

SEQ ID NO: 6934 - DNA, 27 bp; single-stranded, linear
  The letter "N" represents the stem II region of an HH ribozyme.
gucuaggacugaugangaaacgucccu

SEQ ID NO: 6935 - DNA, 27 bp; single-stranded, linear
  The letter "N" represents the stem II region of an HH ribozyme.
ggucuaggcugaugangaaaacguccc

SEQ ID NO: 6936 - DNA, 27 bp; single-stranded, linear
  The letter "N" represents the stem II region of an HH ribozyme.
uggucuagcugaugangaaaaacgucc

SEQ ID NO: 6937 - DNA, 27 bp; single-stranded, linear
  The letter "N" represents the stem II region of an HH ribozyme.
cccugguccugaugangaaaggaaacg

SEQ ID NO: 6938 - DNA, 27 bp; single-stranded, linear
  The letter "N" represents the stem II region of an HH ribozyme.
uucccgagcugaugangaaacaugugc

SEQ ID NO: 6939 - DNA, 27 bp; single-stranded, linear
  The letter "N" represents the stem II region of an HH ribozyme.
guucccgacugaugangaaaacaugug

SEQ ID NO: 6940 - DNA, 27 bp; single-stranded, linear
  The letter "N" represents the stem II region of an HH ribozyme.
ugguuccccugaugangaaagaacaug

SEQ ID NO: 6941 - DNA, 27 bp; single-stranded, linear
  The letter "N" represents the stem II region of an HH ribozyme.
uuaagauucugaugangaaacuguggu

SEQ ID NO: 6942 - DNA, 27 bp; single-stranded, linear
  The letter "N" represents the stem II region of an HH ribozyme.
uuuaagaucugaugangaaaacugugg

SEQ ID NO: 6943 - DNA, 27 bp; single-stranded, linear
  The letter "N" represents the stem II region of an HH ribozyme.
agauuuaacugaugangaaauuaacug

SEQ ID NO: 6944 - DNA, 27 bp; single-stranded, linear
  The letter "N" represents the stem II region of an HH ribozyme.
aaagauuucugaugangaaagauuaac

SEQ ID NO: 6945 - DNA, 27 bp; single-stranded, linear
  The letter "N" represents the stem II region of an HH ribozyme.
aaaagauucugaugangaaaagauuaa

SEQ ID NO: 6946 - DNA, 27 bp; single-stranded, linear
  The letter "N" represents the stem II region of an HH ribozyme.
cgggaaaacugaugangaaauuuaaga

SEQ ID NO: 6947 - DNA, 27 bp; single-stranded, linear
  The letter "N" represents the stem II region of an HH ribozyme.
cccgggaacugaugangaaagauuuaa

SEQ ID NO: 6948 - DNA, 27 bp; single-stranded, linear
  The letter "N" represents the stem II region of an HH ribozyme.
ucccgggacugaugangaaaagauuua

SEQ ID NO: 6949 - DNA, 27 bp; single-stranded, linear
  The letter "N" represents the stem II region of an HH ribozyme.
cucccgggcugaugangaaaaagauuu

SEQ ID NO: 6950 - DNA, 27 bp; single-stranded, linear
  The letter "N" represents the stem II region of an HH ribozyme.
acucccggcugaugangaaaaaagauu

SEQ ID NO: 6951 - DNA, 27 bp; single-stranded, linear
  The letter "N" represents the stem II region of an HH ribozyme.
caacagaacugaugangaaacucccgg

SEQ ID NO: 6952 - DNA, 27 bp; single-stranded, linear
  The letter "N" represents the stem II region of an HH ribozyme.
gacaacagcugaugangaaagacuccc

SEQ ID NO: 6953 - DNA, 27 bp; single-stranded, linear
  The letter "N" represents the stem II region of an HH ribozyme.
agacaacacugaugangaaaagacucc

SEQ ID NO: 6954 - DNA, 27 bp; single-stranded, linear
  The letter "N" represents the stem II region of an HH ribozyme.
aaacagaccugaugangaaacagaaga

SEQ ID NO: 6955 - DNA, 27 bp; single-stranded, linear
  The letter "N" represents the stem II region of an HH ribozyme.
gguaaacacugaugangaaacaacaga

SEQ ID NO: 6956 - DNA, 27 bp; single-stranded, linear
  The letter "N" represents the stem II region of an HH ribozyme.
ggaugguacugaugangaaacagacaa

SEQ ID NO: 6957 - DNA, 27 bp; single-stranded, linear
  The letter "N" represents the stem II region of an HH ribozyme.
uggauggucugaugangaaaacagaca

SEQ ID NO: 6958 - DNA, 27 bp; single-stranded, linear
  The letter "N" represents the stem II region of an HH ribozyme.
uuggauggcugaugangaaaaacagac

SEQ ID NO: 6959 - DNA, 27 bp; single-stranded, linear
  The letter "N" represents the stem II region of an HH ribozyme.
augcuuugcugaugangaaaugguaaa

SEQ ID NO: 6960 - DNA, 27 bp; single-stranded, linear
  The letter "N" represents the stem II region of an HH ribozyme.
auguuaaacugaugangaaaugcuuug

SEQ ID NO: 6961 - DNA, 27 bp; single-stranded, linear
  The letter "N" represents the stem II region of an HH ribozyme.
acauguuacugaugangaaauaugcuu

SEQ ID NO: 6962 - DNA, 27 bp; single-stranded, linear
  The letter "N" represents the stem II region of an HH ribozyme.
cacauguucugaugangaaaauaugcu

SEQ ID NO: 6963 - DNA, 27 bp; single-stranded, linear
  The letter "N" represents the stem II region of an HH ribozyme.
acacaugucugaugangaaaaauaugc

SEQ ID NO: 6964 - DNA, 27 bp; single-stranded, linear
  The letter "N" represents the stem II region of an HH ribozyme.
cccccacucugaugangaaacacaugu

SEQ ID NO: 6965 - DNA, 27 bp; single-stranded, linear
  The letter "N" represents the stem II region of an HH ribozyme.
cagaagcccugaugangaaagcgccac

SEQ ID NO: 6966 - DNA, 27 bp; single-stranded, linear
  The letter "N" represents the stem II region of an HH ribozyme.
ggccucagcugaugangaaagccaagc

SEQ ID NO: 6967 - DNA, 27 bp; single-stranded, linear
  The letter "N" represents the stem II region of an HH ribozyme.
uggccucacugaugangaaaagccaag

SEQ ID NO: 6968 - DNA, 27 bp; single-stranded, linear
  The letter "N" represents the stem II region of an HH ribozyme.
gaacugaucugaugangaaauggcucu

SEQ ID NO: 6969 - DNA, 27 bp; single-stranded, linear
  The letter "N" represents the stem II region of an HH ribozyme.
gaggaacucugaugangaaaugauggc

SEQ ID NO: 6970 - DNA, 27 bp; single-stranded, linear
  The letter "N" represents the stem II region of an HH ribozyme.
acuagaggcugaugangaaacugauga

SEQ ID NO: 6971 - DNA, 27 bp; single-stranded, linear
  The letter "N" represents the stem II region of an HH ribozyme.
cacuagagcugaugangaaaacugaug

SEQ ID NO: 6972 - DNA, 27 bp; single-stranded, linear
  The letter "N" represents the stem II region of an HH ribozyme.
ucucacuacugaugangaaaggaacug

SEQ ID NO: 6973 - DNA, 27 bp; single-stranded, linear
  The letter "N" represents the stem II region of an HH ribozyme.
caucucaccugaugangaaagaggaac

SEQ ID NO: 6974 - DNA, 27 bp; single-stranded, linear
  The letter "N" represents the stem II region of an HH ribozyme.
augaccuccugaugangaaaugcaucu

SEQ ID NO: 6975 - DNA, 27 bp; single-stranded, linear
  The letter "N" represents the stem II region of an HH ribozyme.
uuggguaucugaugangaaaccucaau

SEQ ID NO: 6976 - DNA, 27 bp; single-stranded, linear
  The letter "N" represents the stem II region of an HH ribozyme.
agcuugggcugaugangaaaugaccuc

SEQ ID NO: 6977 - DNA, 27 bp; single-stranded, linear
  The letter "N" represents the stem II region of an HH ribozyme.
aggccugccugaugangaaagcuuggg

SEQ ID NO: 6978 - DNA, 27 bp; single-stranded, linear
  The letter "N" represents the stem II region of an HH ribozyme.
aguaugcgcugaugangaaaggucagg

SEQ ID NO: 6979 - DNA, 27 bp; single-stranded, linear
  The letter "N" represents the stem II region of an HH ribozyme.
caguaugccugaugangaaaaggucag

SEQ ID NO: 6980 - DNA, 27 bp; single-stranded, linear
  The letter "N" represents the stem II region of an HH ribozyme.
gugagcagcugaugangaaaugcgaag

SEQ ID NO: 6981 - DNA, 27 bp; single-stranded, linear
  The letter "N" represents the stem II region of an HH ribozyme.
cuccccgucugaugangaaagcaguau

SEQ ID NO: 6982 - DNA, 27 bp; single-stranded, linear
  The letter "N" represents the stem II region of an HH ribozyme.
gaccacuucugaugangaaacuccccg

SEQ ID NO: 6983 - DNA, 27 bp; single-stranded, linear
  The letter "N" represents the stem II region of an HH ribozyme.
ggaccacucugaugangaaaacucccc

SEQ ID NO: 6984 - DNA, 27 bp; single-stranded, linear
  The letter "N" represents the stem II region of an HH ribozyme.
ccaaacugcugaugangaaaccacuua

SEQ ID NO: 6985 - DNA, 27 bp; single-stranded, linear
  The letter "N" represents the stem II region of an HH ribozyme.
cuaggccacugaugangaaacuggacc

SEQ ID NO: 6986 - DNA, 27 bp; single-stranded, linear
  The letter "N" represents the stem II region of an HH ribozyme.
acuaggcccugaugangaaaacuggac

SEQ ID NO: 6987 - DNA, 27 bp; single-stranded, linear
  The letter "N" represents the stem II region of an HH ribozyme.
aaccuuaccugaugangaaaggccaaa

SEQ ID NO: 6988 - DNA, 27 bp; single-stranded, linear
  The letter "N" represents the stem II region of an HH ribozyme.
ggcaaccucugaugangaaacuaggcc

SEQ ID NO: 6989 - DNA, 27 bp; single-stranded, linear
  The letter "N" represents the stem II region of an HH ribozyme.
caguaggccugaugangaaaccuuacu

SEQ ID NO: 6990 - DNA, 27 bp; single-stranded, linear
  The letter "N" represents the stem II region of an HH ribozyme.
cccaucagcugaugangaaaggcaacc

SEQ ID NO: 6991 - DNA, 27 bp; single-stranded, linear
  The letter "N" represents the stem II region of an HH ribozyme.
uggcuuuucugaugangaaagcccauc

SEQ ID NO: 6992 - DNA, 27 bp; single-stranded, linear
  The letter "N" represents the stem II region of an HH ribozyme.
cuguuuaacugaugangaaauguggcu

SEQ ID NO: 6993 - DNA, 27 bp; single-stranded, linear
  The letter "N" represents the stem II region of an HH ribozyme.
ccuguuuacugaugangaaaauguggc

SEQ ID NO: 6994 - DNA, 27 bp; single-stranded, linear
  The letter "N" represents the stem II region of an HH ribozyme.
accuguuucugaugangaaaaaugugg

SEQ ID NO: 6995 - DNA, 27 bp; single-stranded, linear
  The letter "N" represents the stem II region of an HH ribozyme.
aaccuguucugaugangaaaaaaugug

SEQ ID NO: 6996 - DNA, 27 bp; single-stranded, linear
  The letter "N" represents the stem II region of an HH ribozyme.
ugagauaacugaugangaaaccuguuu

SEQ ID NO: 6997 - DNA, 27 bp; single-stranded, linear
  The letter "N" represents the stem II region of an HH ribozyme.
uugagauacugaugangaaaaccuguu

SEQ ID NO: 6998 - DNA, 27 bp; single-stranded, linear
  The letter "N" represents the stem II region of an HH ribozyme.
cuugagaucugaugangaaaaaccugu

SEQ ID NO: 6999 - DNA, 27 bp; single-stranded, linear
  The letter "N" represents the stem II region of an HH ribozyme.
acuugagacugaugangaaaaaaccug

SEQ ID NO: 7000 - DNA, 27 bp; single-stranded, linear
  The letter "N" represents the stem II region of an HH ribozyme.
auacuugacugaugangaaauaaaacc

SEQ ID NO: 7001 - DNA, 27 bp; single-stranded, linear
  The letter "N" represents the stem II region of an HH ribozyme.
uaauacuucugaugangaaagauaaaa

SEQ ID NO: 7002 - DNA, 27 bp; single-stranded, linear
  The letter "N" represents the stem II region of an HH ribozyme.
uauauuaacugaugangaaacuugaga

SEQ ID NO: 7003 - DNA, 27 bp; single-stranded, linear
  The letter "N" represents the stem II region of an HH ribozyme.
uauauauucugaugangaaauacuuga

SEQ ID NO: 7004 - DNA, 27 bp; single-stranded, linear
  The letter "N" represents the stem II region of an HH ribozyme.
cuauauaucugaugangaaaauacuug

SEQ ID NO: 7005 - DNA, 27 bp; single-stranded, linear
  The letter "N" represents the stem II region of an HH ribozyme.
ugucuauacugaugangaaauuaauac

SEQ ID NO: 7006 - DNA, 27 bp; single-stranded, linear
  The letter "N" represents the stem II region of an HH ribozyme.
cuugucuacugaugangaaauauuaau

SEQ ID NO: 7007 - DNA, 27 bp; single-stranded, linear
  The letter "N" represents the stem II region of an HH ribozyme.
gucuuguccugaugangaaauauauua

SEQ ID NO: 7008 - DNA, 27 bp; single-stranded, linear
  The letter "N" represents the stem II region of an HH ribozyme.
uaaugcaucugaugangaaagugucuu

SEQ ID NO: 7009 - DNA, 27 bp; single-stranded, linear
  The letter "N" represents the stem II region of an HH ribozyme.
auaaugcacugaugangaaaagugucu

SEQ ID NO: 7010 - DNA, 27 bp; single-stranded, linear
  The letter "N" represents the stem II region of an HH ribozyme.
aacaggaucugaugangaaaugcauaa

SEQ ID NO: 7011 - DNA, 27 bp; single-stranded, linear
  The letter "N" represents the stem II region of an HH ribozyme.
aaacaggacugaugangaaaaugcaua

SEQ ID NO: 7012 - DNA, 27 bp; single-stranded, linear
  The letter "N" represents the stem II region of an HH ribozyme.
uaaaacagcugaugangaaauaaugca

SEQ ID NO: 7013 - DNA, 27 bp; single-stranded, linear
  The letter "N" represents the stem II region of an HH ribozyme.
auauauaacugaugangaaacaggaua

SEQ ID NO: 7014 - DNA, 27 bp; single-stranded, linear
  The letter "N" represents the stem II region of an HH ribozyme.
gauauauacugaugangaaaacaggau

SEQ ID NO: 7015 - DNA, 27 bp; single-stranded, linear
  The letter "N" represents the stem II region of an HH ribozyme.
ggauauaucugaugangaaaaacagga

SEQ ID NO: 7016 - DNA, 27 bp; single-stranded, linear
  The letter "N" represents the stem II region of an HH ribozyme.
uggauauacugaugangaaaaaacagg

SEQ ID NO: 7017 - DNA, 27 bp; single-stranded, linear
  The letter "N" represents the stem II region of an HH ribozyme.
auuggauacugaugangaaauaaaaca

SEQ ID NO: 7018 - DNA, 27 bp; single-stranded, linear
  The letter "N" represents the stem II region of an HH ribozyme.
ucauuggacugaugangaaauauaaaa

SEQ ID NO: 7019 - DNA, 27 bp; single-stranded, linear
  The letter "N" represents the stem II region of an HH ribozyme.
auucauugcugaugangaaauauauaa

SEQ ID NO: 7020 - DNA, 27 bp; single-stranded, linear
  The letter "N" represents the stem II region of an HH ribozyme.
cccaguuacugaugangaaauucauug

SEQ ID NO: 7021 - DNA, 27 bp; single-stranded, linear
  The letter "N" represents the stem II region of an HH ribozyme.
gccccagucugaugangaaauauucau

SEQ ID NO: 7022 - DNA, 27 bp; single-stranded, linear
  The letter "N" represents the stem II region of an HH ribozyme.
ugacucuucugaugangaaacucgccc

SEQ ID NO: 7023 - DNA, 27 bp; single-stranded, linear
  The letter "N" represents the stem II region of an HH ribozyme.
augacucucugaugangaaaacucgcc

SEQ ID NO: 7024 - DNA, 27 bp; single-stranded, linear
  The letter "N" represents the stem II region of an HH ribozyme.
uagaccaucugaugangaaacucuuaa

SEQ ID NO: 7025 - DNA, 27 bp; single-stranded, linear
  The letter "N" represents the stem II region of an HH ribozyme.
cuuuucuacugaugangaaaccaugac

SEQ ID NO: 7026 - DNA, 27 bp; single-stranded, linear
  The letter "N" represents the stem II region of an HH ribozyme.
cccuuuuccugaugangaaagaccaug

SEQ ID NO: 7027 - DNA, 27 bp; single-stranded, linear
  The letter "N" represents the stem II region of an HH ribozyme.
uacagagacugaugangaaaccccuuu

SEQ ID NO: 7028 - DNA, 27 bp; single-stranded, linear
  The letter "N" represents the stem II region of an HH ribozyme.
guacagagcugaugangaaaaccccuu

SEQ ID NO: 7029 - DNA, 27 bp; single-stranded, linear
  The letter "N" represents the stem II region of an HH ribozyme.
gguacagacugaugangaaaaaccccu

SEQ ID NO: 7030 - DNA, 27 bp; single-stranded, linear
  The letter "N" represents the stem II region of an HH ribozyme.
uggguacacugaugangaaagaaaccc

SEQ ID NO: 7031 - DNA, 27 bp; single-stranded, linear
  The letter "N" represents the stem II region of an HH ribozyme.
gauuugggcugaugangaaacagagaa

SEQ ID NO: 7032 - DNA, 27 bp; single-stranded, linear
  The letter "N" represents the stem II region of an HH ribozyme.
accagccccugaugangaaauuugggu

SEQ ID NO: 7033 - DNA, 27 bp; single-stranded, linear
  The letter "N" represents the stem II region of an HH ribozyme.
cuuggucccugaugangaaaccagccc

SEQ ID NO: 7034 - DNA, 27 bp; single-stranded, linear
  The letter "N" represents the stem II region of an HH ribozyme.
gcugggaccugaugangaaaccacucu

SEQ ID NO: 7035 - DNA, 27 bp; single-stranded, linear
  The letter "N" represents the stem II region of an HH ribozyme.
auagcuggcugaugangaaacaaccac

SEQ ID NO: 7036 - DNA, 27 bp; single-stranded, linear
  The letter "N" represents the stem II region of an HH ribozyme.
aguaacuacugaugangaaagcuggga

SEQ ID NO: 7037 - DNA, 27 bp; single-stranded, linear
  The letter "N" represents the stem II region of an HH ribozyme.
uuaguaaccugaugangaaauagcugg

SEQ ID NO: 7038 - DNA, 27 bp; single-stranded, linear
  The letter "N" represents the stem II region of an HH ribozyme.
aguuuagucugaugangaaacuauagc

SEQ ID NO: 7039 - DNA, 27 bp; single-stranded, linear
  The letter "N" represents the stem II region of an HH ribozyme.
uaguuuagcugaugangaaaacuauag

SEQ ID NO: 7040 - DNA, 27 bp; single-stranded, linear
  The letter "N" represents the stem II region of an HH ribozyme.
gaguaguucugaugangaaaguaacua

SEQ ID NO: 7041 - DNA, 27 bp; single-stranded, linear
  The letter "N" represents the stem II region of an HH ribozyme.
ugggugagcugaugangaaaguuuagu

SEQ ID NO: 7042 - DNA, 27 bp; single-stranded, linear
  The letter "N" represents the stem II region of an HH ribozyme.
cuuugggucugaugangaaaguaguuu

SEQ ID NO: 7043 - DNA, 27 bp; single-stranded, linear
  The letter "N" represents the stem II region of an HH ribozyme.
gagguccccugaugangaaacuuuggg

SEQ ID NO: 7044 - DNA, 27 bp; single-stranded, linear
  The letter "N" represents the stem II region of an HH ribozyme.
aagccagucugaugangaaagguccca

SEQ ID NO: 7045 - DNA, 27 bp; single-stranded, linear
  The letter "N" represents the stem II region of an HH ribozyme.
guaaagagcugaugangaaagccagug

SEQ ID NO: 7046 - DNA, 27 bp; single-stranded, linear
  The letter "N" represents the stem II region of an HH ribozyme.
aguaaagacugaugangaaaagccagu

SEQ ID NO: 7047 - DNA, 27 bp; single-stranded, linear
  The letter "N" represents the stem II region of an HH ribozyme.
gaaguaaacugaugangaaagaagcca

SEQ ID NO: 7048 - DNA, 27 bp; single-stranded, linear
  The letter "N" represents the stem II region of an HH ribozyme.
augaaguacugaugangaaagagaagc

SEQ ID NO: 7049 - DNA, 27 bp; single-stranded, linear
  The letter "N" represents the stem II region of an HH ribozyme.
gaugaagucugaugangaaaagagaag

SEQ ID NO: 7050 - DNA, 27 bp; single-stranded, linear
  The letter "N" represents the stem II region of an HH ribozyme.
ugaugaagcugaugangaaaaagagaa

SEQ ID NO: 7051 - DNA, 27 bp; single-stranded, linear
  The letter "N" represents the stem II region of an HH ribozyme.
ccaugaugcugaugangaaaguaaaga

SEQ ID NO: 7052 - DNA, 27 bp; single-stranded, linear
  The letter "N" represents the stem II region of an HH ribozyme.
uccaugaucugaugangaaaaguaaag

SEQ ID NO: 7053 - DNA, 27 bp; single-stranded, linear
  The letter "N" represents the stem II region of an HH ribozyme.
aaauccaucugaugangaaaugaagua

SEQ ID NO: 7054 - DNA, 27 bp; single-stranded, linear
  The letter "N" represents the stem II region of an HH ribozyme.
gauggugacugaugangaaauccauga

SEQ ID NO: 7055 - DNA, 27 bp; single-stranded, linear
  The letter "N" represents the stem II region of an HH ribozyme.
ggauggugcugaugangaaaauccaug

SEQ ID NO: 7056 - DNA, 27 bp; single-stranded, linear
  The letter "N" represents the stem II region of an HH ribozyme.
gggauggucugaugangaaaaauccau

SEQ ID NO: 7057 - DNA, 27 bp; single-stranded, linear
  The letter "N" represents the stem II region of an HH ribozyme.
ugccuuggcugaugangaaauggugaa

SEQ ID NO: 7058 - DNA, 27 bp; single-stranded, linear
  The letter "N" represents the stem II region of an HH ribozyme.
uccucucacugaugangaaacugccuu

SEQ ID NO: 7059 - DNA, 27 bp; single-stranded, linear
  The letter "N" represents the stem II region of an HH ribozyme.
auacucuucugaugangaaagcuccuc

SEQ ID NO: 7060 - DNA, 27 bp; single-stranded, linear
  The letter "N" represents the stem II region of an HH ribozyme.
ugggcugacugaugangaaacucuuua

SEQ ID NO: 7061 - DNA, 27 bp; single-stranded, linear
  The letter "N" represents the stem II region of an HH ribozyme.
uaugggcucugaugangaaauacucuu

SEQ ID NO: 7062 - DNA, 27 bp; single-stranded, linear
  The letter "N" represents the stem II region of an HH ribozyme.
uuaauaaacugaugangaaaugggcug

SEQ ID NO: 7063 - DNA, 27 bp; single-stranded, linear
  The letter "N" represents the stem II region of an HH ribozyme.
gcuuaauacugaugangaaauaugggc

SEQ ID NO: 7064 - DNA, 27 bp; single-stranded, linear
  The letter "N" represents the stem II region of an HH ribozyme.
ugcuuaaucugaugangaaaauauggg

SEQ ID NO: 7065 - DNA, 27 bp; single-stranded, linear
  The letter "N" represents the stem II region of an HH ribozyme.
gugcuuaacugaugangaaaaauaugg

SEQ ID NO: 7066 - DNA, 27 bp; single-stranded, linear
  The letter "N" represents the stem II region of an HH ribozyme.
aagugcuucugaugangaaauaaauau

SEQ ID NO: 7067 - DNA, 27 bp; single-stranded, linear
  The letter "N" represents the stem II region of an HH ribozyme.
aaagugcucugaugangaaaauaaaua

SEQ ID NO: 7068 - DNA, 27 bp; single-stranded, linear
  The letter "N" represents the stem II region of an HH ribozyme.
ggagcauacugaugangaaagugcuua

SEQ ID NO: 7069 - DNA, 27 bp; single-stranded, linear
  The letter "N" represents the stem II region of an HH ribozyme.
aggagcaucugaugangaaaagugcuu

SEQ ID NO: 7070 - DNA, 27 bp; single-stranded, linear
  The letter "N" represents the stem II region of an HH ribozyme.
aaggagcacugaugangaaaaagugcu

SEQ ID NO: 7071 - DNA, 27 bp; single-stranded, linear
  The letter "N" represents the stem II region of an HH ribozyme.
gugccaagcugaugangaaagcauaaa

SEQ ID NO: 7072 - DNA, 27 bp; single-stranded, linear
  The letter "N" represents the stem II region of an HH ribozyme.
gcugugcccugaugangaaaggagcau

SEQ ID NO: 7073 - DNA, 27 bp; single-stranded, linear
  The letter "N" represents the stem II region of an HH ribozyme.
gcauaaaucugaugangaaacacauca

SEQ ID NO: 7074 - DNA, 27 bp; single-stranded, linear
  The letter "N" represents the stem II region of an HH ribozyme.
cuugcauacugaugangaaauuacaca

SEQ ID NO: 7075 - DNA, 27 bp; single-stranded, linear
  The letter "N" represents the stem II region of an HH ribozyme.
gcuugcaucugaugangaaaauuacac

SEQ ID NO: 7076 - DNA, 27 bp; single-stranded, linear
  The letter "N" represents the stem II region of an HH ribozyme.
agcuugcacugaugangaaaaauuaca

SEQ ID NO: 7077 - DNA, 27 bp; single-stranded, linear
  The letter "N" represents the stem II region of an HH ribozyme.
uggagaggcugaugangaaagcuugca

SEQ ID NO: 7078 - DNA, 27 bp; single-stranded, linear
  The letter "N" represents the stem II region of an HH ribozyme.
uagcuggacugaugangaaagggagcu

SEQ ID NO: 7079 - DNA, 27 bp; single-stranded, linear
  The letter "N" represents the stem II region of an HH ribozyme.
ccuagcugcugaugangaaagagggag

SEQ ID NO: 7080 - DNA, 27 bp; single-stranded, linear
  The letter "N" represents the stem II region of an HH ribozyme.
cugagucccugaugangaaagcuggag

SEQ ID NO: 7081 - DNA, 27 bp; single-stranded, linear
  The letter "N" represents the stem II region of an HH ribozyme.
aauauccucugaugangaaaguccuag

SEQ ID NO: 7082 - DNA, 27 bp; single-stranded, linear
  The letter "N" represents the stem II region of an HH ribozyme.
uugacuaacugaugangaaauccugag

SEQ ID NO: 7083 - DNA, 27 bp; single-stranded, linear
  The letter "N" represents the stem II region of an HH ribozyme.
cauugacucugaugangaaauauccug

SEQ ID NO: 7084 - DNA, 27 bp; single-stranded, linear
  The letter "N" represents the stem II region of an HH ribozyme.
ucauugaccugaugangaaaauauccu

SEQ ID NO: 7085 - DNA, 27 bp; single-stranded, linear
  The letter "N" represents the stem II region of an HH ribozyme.
ggcucauucugaugangaaacuaauau

SEQ ID NO: 7086 - DNA, 27 bp; single-stranded, linear
  The letter "N" represents the stem II region of an HH ribozyme.
uuccuuuucugaugangaaauggcuca

SEQ ID NO: 7087 - DNA, 27 bp; single-stranded, linear
  The letter "N" represents the stem II region of an HH ribozyme.
aaauaagacugaugangaaagguuuuu

SEQ ID NO: 7088 - DNA, 27 bp; single-stranded, linear
  The letter "N" represents the stem II region of an HH ribozyme.
gaaaauaacugaugangaaauagguuu

SEQ ID NO: 7089 - DNA, 27 bp; single-stranded, linear
  The letter "N" represents the stem II region of an HH ribozyme.
augaaaaucugaugangaaagauaggu

SEQ ID NO: 7090 - DNA, 27 bp; single-stranded, linear
  The letter "N" represents the stem II region of an HH ribozyme.
gaugaaaacugaugangaaaagauagg

SEQ ID NO: 7091 - DNA, 27 bp; single-stranded, linear
  The letter "N" represents the stem II region of an HH ribozyme.
cagaugaacugaugangaaauaagaua

SEQ ID NO: 7092 - DNA, 27 bp; single-stranded, linear
  The letter "N" represents the stem II region of an HH ribozyme.
acagaugacugaugangaaaauaagau

SEQ ID NO: 7093 - DNA, 27 bp; single-stranded, linear
  The letter "N" represents the stem II region of an HH ribozyme.
aacagaugcugaugangaaaaauaaga

SEQ ID NO: 7094 - DNA, 27 bp; single-stranded, linear
  The letter "N" represents the stem II region of an HH ribozyme.
aaacagaucugaugangaaaaaauaag

SEQ ID NO: 7095 - DNA, 27 bp; single-stranded, linear
  The letter "N" represents the stem II region of an HH ribozyme.
augaaacacugaugangaaaugaaaau

SEQ ID NO: 7096 - DNA, 27 bp; single-stranded, linear
  The letter "N" represents the stem II region of an HH ribozyme.
agguaugacugaugangaaacagauga

SEQ ID NO: 7097 - DNA, 27 bp; single-stranded, linear
  The letter "N" represents the stem II region of an HH ribozyme.
aagguaugcugaugangaaaacagaug

SEQ ID NO: 7098 - DNA, 27 bp; single-stranded, linear
  The letter "N" represents the stem II region of an HH ribozyme.
caagguaucugaugangaaaaacagau

SEQ ID NO: 7099 - DNA, 27 bp; single-stranded, linear
  The letter "N" represents the stem II region of an HH ribozyme.
agacaaggcugaugangaaaugaaaca

SEQ ID NO: 7100 - DNA, 27 bp; single-stranded, linear
  The letter "N" represents the stem II region of an HH ribozyme.
ccccagaccugaugangaaagguauga

SEQ ID NO: 7101 - DNA, 27 bp; single-stranded, linear
  The letter "N" represents the stem II region of an HH ribozyme.
agaccccacugaugangaaacaaggua

SEQ ID NO: 7102 - DNA, 27 bp; single-stranded, linear
  The letter "N" represents the stem II region of an HH ribozyme.
cgucauuacugaugangaaaccccaga

SEQ ID NO: 7103 - DNA, 27 bp; single-stranded, linear
  The letter "N" represents the stem II region of an HH ribozyme.
aucgucaucugaugangaaagacccca

SEQ ID NO: 7104 - DNA, 27 bp; single-stranded, linear
  The letter "N" represents the stem II region of an HH ribozyme.
cccauguccugaugangaaacccuguu

SEQ ID NO: 7105 - DNA, 27 bp; single-stranded, linear
  The letter "N" represents the stem II region of an HH ribozyme.
cccuuuuccugaugangaaacccuguc

SEQ ID NO: 7106 - DNA, 27 bp; single-stranded, linear
  The letter "N" represents the stem II region of an HH ribozyme.
accccaaacugaugangaaagcgggca

SEQ ID NO: 7107 - DNA, 27 bp; single-stranded, linear
  The letter "N" represents the stem II region of an HH ribozyme.
agaccccacugaugangaaagagcggg

SEQ ID NO: 7108 - DNA, 27 bp; single-stranded, linear
  The letter "N" represents the stem II region of an HH ribozyme.
uagacccccugaugangaaaagagcgg

SEQ ID NO: 7109 - DNA, 27 bp; single-stranded, linear
  The letter "N" represents the stem II region of an HH ribozyme.
caucucuacugaugangaaaccccaaa

SEQ ID NO: 7110 - DNA, 27 bp; single-stranded, linear
  The letter "N" represents the stem II region of an HH ribozyme.
cucaucuccugaugangaaagacccca

SEQ ID NO: 7111 - DNA, 27 bp; single-stranded, linear
  The letter "N" represents the stem II region of an HH ribozyme.
auuuuagacugaugangaaacccaggg

SEQ ID NO: 7112 - DNA, 27 bp; single-stranded, linear
  The letter "N" represents the stem II region of an HH ribozyme.
ccauuuuacugaugangaaagacccag

SEQ ID NO: 7113 - DNA, 27 bp; single-stranded, linear
  The letter "N" represents the stem II region of an HH ribozyme.
agccauuucugaugangaaagagaccc

SEQ ID NO: 7114 - DNA, 27 bp; single-stranded, linear
  The letter "N" represents the stem II region of an HH ribozyme.
uucuaagacugaugangaaagccauuu

SEQ ID NO: 7115 - DNA, 27 bp; single-stranded, linear
  The letter "N" represents the stem II region of an HH ribozyme.
acuucuaacugaugangaaagagccau

SEQ ID NO: 7116 - DNA, 27 bp; single-stranded, linear
  The letter "N" represents the stem II region of an HH ribozyme.
caacuucucugaugangaaagagagcc

SEQ ID NO: 7117 - DNA, 27 bp; single-stranded, linear
  The letter "N" represents the stem II region of an HH ribozyme.
acaacuuccugaugangaaaagagagc

SEQ ID NO: 7118 - DNA, 27 bp; single-stranded, linear
  The letter "N" represents the stem II region of an HH ribozyme.
gcacauaccugaugangaaacuucuaa

SEQ ID NO: 7119 - DNA, 27 bp; single-stranded, linear
  The letter "N" represents the stem II region of an HH ribozyme.
uuugcacacugaugangaaacaacuuc

SEQ ID NO: 7120 - DNA, 27 bp; single-stranded, linear
  The letter "N" represents the stem II region of an HH ribozyme.
cagaccaucugaugangaaauuugcac

SEQ ID NO: 7121 - DNA, 27 bp; single-stranded, linear
  The letter "N" represents the stem II region of an HH ribozyme.
acagaccacugaugangaaaauuugca

SEQ ID NO: 7122 - DNA, 27 bp; single-stranded, linear
  The letter "N" represents the stem II region of an HH ribozyme.
agcacacacugaugangaaaccauaau

SEQ ID NO: 7123 - DNA, 27 bp; single-stranded, linear
  The letter "N" represents the stem II region of an HH ribozyme.
cacgaccucugaugangaaagcacaca

SEQ ID NO: 7124 - DNA, 27 bp; single-stranded, linear
  The letter "N" represents the stem II region of an HH ribozyme.
gcacgacccugaugangaaaagcacac

SEQ ID NO: 7125 - DNA, 27 bp; single-stranded, linear
  The letter "N" represents the stem II region of an HH ribozyme.
gugugcaccugaugangaaaccuaagc

SEQ ID NO: 7126 - DNA, 27 bp; single-stranded, linear
  The letter "N" represents the stem II region of an HH ribozyme.
ccagcugucugaugangaaaccggcuc

SEQ ID NO: 7127 - DNA, 27 bp; single-stranded, linear
  The letter "N" represents the stem II region of an HH ribozyme.
aaagcagccugaugangaaauucaucg

SEQ ID NO: 7128 - DNA, 27 bp; single-stranded, linear
  The letter "N" represents the stem II region of an HH ribozyme.
cucucccacugaugangaaagcagcua

SEQ ID NO: 7129 - DNA, 27 bp; single-stranded, linear
  The letter "N" represents the stem II region of an HH ribozyme.
gcucuccccugaugangaaaagcagcu

SEQ ID NO: 7130 - DNA, 27 bp; single-stranded, linear
  The letter "N" represents the stem II region of an HH ribozyme.
uaaguggccugaugangaaagcaugcu

SEQ ID NO: 7131 - DNA, 27 bp; single-stranded, linear
  The letter "N" represents the stem II region of an HH ribozyme.
agagaauucugaugangaaaguggcua

SEQ ID NO: 7132 - DNA, 27 bp; single-stranded, linear
  The letter "N" represents the stem II region of an HH ribozyme.
cagagaaucugaugangaaaaguggcu

SEQ ID NO: 7133 - DNA, 27 bp; single-stranded, linear
  The letter "N" represents the stem II region of an HH ribozyme.
ggucagagcugaugangaaauuaagug

SEQ ID NO: 7134 - DNA, 27 bp; single-stranded, linear
  The letter "N" represents the stem II region of an HH ribozyme.
cggucagacugaugangaaaauuaagu

SEQ ID NO: 7135 - DNA, 27 bp; single-stranded, linear
  The letter "N" represents the stem II region of an HH ribozyme.
cccggucacugaugangaaagaauuaa

SEQ ID NO: 7136 - DNA, 27 bp; single-stranded, linear
  The letter "N" represents the stem II region of an HH ribozyme.
guacccaucugaugangaaaugcuggc

SEQ ID NO: 7137 - DNA, 27 bp; single-stranded, linear
  The letter "N" represents the stem II region of an HH ribozyme.
ggagcaggcugaugangaaacccauga

SEQ ID NO: 7138 - DNA, 27 bp; single-stranded, linear
  The letter "N" represents the stem II region of an HH ribozyme.
acacagggcugaugangaaagcaggua

SEQ ID NO: 7139 - DNA, 27 bp; single-stranded, linear
  The letter "N" represents the stem II region of an HH ribozyme.
ggauggggcugaugangaaacacaggg

SEQ ID NO: 7140 - DNA, 27 bp; single-stranded, linear
  The letter "N" represents the stem II region of an HH ribozyme.
accuuaagcugaugangaaauggggua

SEQ ID NO: 7141 - DNA, 27 bp; single-stranded, linear
  The letter "N" represents the stem II region of an HH ribozyme.
aaaaccuucugaugangaaaggauggg

SEQ ID NO: 7142 - DNA, 27 bp; single-stranded, linear
  The letter "N" represents the stem II region of an HH ribozyme.
gaaaaccucugaugangaaaaggaugg

SEQ ID NO: 7143 - DNA, 27 bp; single-stranded, linear
  The letter "N" represents the stem II region of an HH ribozyme.
agacagaacugaugangaaaccuuaag

SEQ ID NO: 7144 - DNA, 27 bp; single-stranded, linear
  The letter "N" represents the stem II region of an HH ribozyme.
cagacagacugaugangaaaaccuuaa

SEQ ID NO: 7145 - DNA, 27 bp; single-stranded, linear
  The letter "N" represents the stem II region of an HH ribozyme.
ucagacagcugaugangaaaaaccuua

SEQ ID NO: 7146 - DNA, 27 bp; single-stranded, linear
  The letter "N" represents the stem II region of an HH ribozyme.
aucagacacugaugangaaaaaaccuu

SEQ ID NO: 7147 - DNA, 27 bp; single-stranded, linear
  The letter "N" represents the stem II region of an HH ribozyme.
ucucaucacugaugangaaacagaaaa

SEQ ID NO: 7148 - DNA, 27 bp; single-stranded, linear
  The letter "N" represents the stem II region of an HH ribozyme.
ucagugggcugaugangaaauugcacu

SEQ ID NO: 7149 - DNA, 27 bp; single-stranded, linear
  The letter "N" represents the stem II region of an HH ribozyme.
ugcaccaacugaugangaaagccacag

SEQ ID NO: 7150 - DNA, 27 bp; single-stranded, linear
  The letter "N" represents the stem II region of an HH ribozyme.
agugcacccugaugangaaagagccac

SEQ ID NO: 7151 - DNA, 27 bp; single-stranded, linear
  The letter "N" represents the stem II region of an HH ribozyme.
uggcuggucugaugangaaagugcacc

SEQ ID NO: 7152 - DNA, 27 bp; single-stranded, linear
  The letter "N" represents the stem II region of an HH ribozyme.
uacuuguccugaugangaaaguccugg

SEQ ID NO: 7153 - DNA, 27 bp; single-stranded, linear
  The letter "N" represents the stem II region of an HH ribozyme.
cccuuucccugaugangaaacuugucu

SEQ ID NO: 7154 - DNA, 27 bp; single-stranded, linear
  The letter "N" represents the stem II region of an HH ribozyme.
guggcuagcugaugangaaagcccuuu

SEQ ID NO: 7155 - DNA, 27 bp; single-stranded, linear
  The letter "N" represents the stem II region of an HH ribozyme.
uguggcuacugaugangaaaagcccuu

SEQ ID NO: 7156 - DNA, 27 bp; single-stranded, linear
  The letter "N" represents the stem II region of an HH ribozyme.
aguguggccugaugangaaagaagccc

SEQ ID NO: 7157 - DNA, 27 bp; single-stranded, linear
  The letter "N" represents the stem II region of an HH ribozyme.
cccuaccucugaugangaaauuuucuu

SEQ ID NO: 7158 - DNA, 27 bp; single-stranded, linear
  The letter "N" represents the stem II region of an HH ribozyme.
gccagccccugaugangaaaccugauu

SEQ ID NO: 7159 - DNA, 27 bp; single-stranded, linear
  The letter "N" represents the stem II region of an HH ribozyme.
uggacaaacugaugangaaaugucuuu

SEQ ID NO: 7160 - DNA, 27 bp; single-stranded, linear
  The letter "N" represents the stem II region of an HH ribozyme.
aauggacacugaugangaaagaugucu

SEQ ID NO: 7161 - DNA, 27 bp; single-stranded, linear
  The letter "N" represents the stem II region of an HH ribozyme.
gaauggaccugaugangaaaagauguc

SEQ ID NO: 7162 - DNA, 27 bp; single-stranded, linear
  The letter "N" represents the stem II region of an HH ribozyme.
ugcgaaugcugaugangaaacaaagau

SEQ ID NO: 7163 - DNA, 27 bp; single-stranded, linear
  The letter "N" represents the stem II region of an HH ribozyme.
cuuuugcgcugaugangaaauggacaa

SEQ ID NO: 7164 - DNA, 27 bp; single-stranded, linear
  The letter "N" represents the stem II region of an HH ribozyme.
gcuuuugccugaugangaaaauggaca

SEQ ID NO: 7165 - DNA, 27 bp; single-stranded, linear
  The letter "N" represents the stem II region of an HH ribozyme.
gccgacaacugaugangaaagcuuuug

SEQ ID NO: 7166 - DNA, 27 bp; single-stranded, linear
  The letter "N" represents the stem II region of an HH ribozyme.
cagccgaccugaugangaaagagcuuu

SEQ ID NO: 7167 - DNA, 27 bp; single-stranded, linear
  The letter "N" represents the stem II region of an HH ribozyme.
cugcagcccugaugangaaacaagagc

SEQ ID NO: 7168 - DNA, 27 bp; single-stranded, linear
  The letter "N" represents the stem II region of an HH ribozyme.
gccugacucugaugangaaacacacug

SEQ ID NO: 7169 - DNA, 27 bp; single-stranded, linear
  The letter "N" represents the stem II region of an HH ribozyme.
caucgccucugaugangaaacuuacac

SEQ ID NO: 7170 - DNA, 27 bp; single-stranded, linear
  The letter "N" represents the stem II region of an HH ribozyme.
uucucuggcugaugangaaagccucug

SEQ ID NO: 7171 - DNA, 27 bp; single-stranded, linear
  The letter "N" represents the stem II region of an HH ribozyme.
ggaugagacugaugangaaaccucagg

SEQ ID NO: 7172 - DNA, 27 bp; single-stranded, linear
  The letter "N" represents the stem II region of an HH ribozyme.
uggaugagcugaugangaaaaccucag

SEQ ID NO: 7173 - DNA, 27 bp; single-stranded, linear
  The letter "N" represents the stem II region of an HH ribozyme.
cuggaugacugaugangaaaaaccuca

SEQ ID NO: 7174 - DNA, 27 bp; single-stranded, linear
  The letter "N" represents the stem II region of an HH ribozyme.
aucuggaucugaugangaaagaaaccu

SEQ ID NO: 7175 - DNA, 27 bp; single-stranded, linear
  The letter "N" represents the stem II region of an HH ribozyme.
gauaucugcugaugangaaaugagaaa

SEQ ID NO: 7176 - DNA, 27 bp; single-stranded, linear
  The letter "N" represents the stem II region of an HH ribozyme.
uugcuggacugaugangaaaucuggau

SEQ ID NO: 7177 - DNA, 27 bp; single-stranded, linear
  The letter "N" represents the stem II region of an HH ribozyme.
aauugcugcugaugangaaauaucugg

SEQ ID NO: 7178 - DNA, 27 bp; single-stranded, linear
  The letter "N" represents the stem II region of an HH ribozyme.
cacccccccugaugangaaauugcugg

SEQ ID NO: 7179 - DNA, 27 bp; single-stranded, linear
  The letter "N" represents the stem II region of an HH ribozyme.
ggaccauccugaugangaaauggucuu

SEQ ID NO: 7180 - DNA, 27 bp; single-stranded, linear
  The letter "N" represents the stem II region of an HH ribozyme.
uaauacagcugaugangaaaccaucua

SEQ ID NO: 7181 - DNA, 27 bp; single-stranded, linear
  The letter "N" represents the stem II region of an HH ribozyme.
cggaauaacugaugangaaacaggacc

SEQ ID NO: 7182 - DNA, 27 bp; single-stranded, linear
  The letter "N" represents the stem II region of an HH ribozyme.
aucggaaucugaugangaaauacagga

SEQ ID NO: 7183 - DNA, 27 bp; single-stranded, linear
  The letter "N" represents the stem II region of an HH ribozyme.
aaucggaacugaugangaaaauacagg

SEQ ID NO: 7184 - DNA, 27 bp; single-stranded, linear
  The letter "N" represents the stem II region of an HH ribozyme.
aaaaucggcugaugangaaauaauaca

SEQ ID NO: 7185 - DNA, 27 bp; single-stranded, linear
  The letter "N" represents the stem II region of an HH ribozyme.
uaaaaucgcugaugangaaaauaauac

SEQ ID NO: 7186 - DNA, 27 bp; single-stranded, linear
  The letter "N" represents the stem II region of an HH ribozyme.
auuauuaacugaugangaaaucggaau

SEQ ID NO: 7187 - DNA, 27 bp; single-stranded, linear
  The letter "N" represents the stem II region of an HH ribozyme.
gauuauuacugaugangaaaaucggaa

SEQ ID NO: 7188 - DNA, 27 bp; single-stranded, linear
  The letter "N" represents the stem II region of an HH ribozyme.
agauuauucugaugangaaaaaucgga

SEQ ID NO: 7189 - DNA, 27 bp; single-stranded, linear
  The letter "N" represents the stem II region of an HH ribozyme.
uagauuaucugaugangaaaaaaucgg

SEQ ID NO: 7190 - DNA, 27 bp; single-stranded, linear
  The letter "N" represents the stem II region of an HH ribozyme.
aauuagaucugaugangaaauuaaaau

SEQ ID NO: 7191 - DNA, 27 bp; single-stranded, linear
  The letter "N" represents the stem II region of an HH ribozyme.
acgaauuacugaugangaaauuauuaa

SEQ ID NO: 7192 - DNA, 27 bp; single-stranded, linear
  The letter "N" represents the stem II region of an HH ribozyme.
ucacgaaucugaugangaaagauuauu

SEQ ID NO: 7193 - DNA, 27 bp; single-stranded, linear
  The letter "N" represents the stem II region of an HH ribozyme.
ugaucacgcugaugangaaauuagauu

SEQ ID NO: 7194 - DNA, 27 bp; single-stranded, linear
  The letter "N" represents the stem II region of an HH ribozyme.
augaucaccugaugangaaaauuagau

SEQ ID NO: 7195 - DNA, 27 bp; single-stranded, linear
  The letter "N" represents the stem II region of an HH ribozyme.
cucuuaaucugaugangaaaucacgaa

SEQ ID NO: 7196 - DNA, 27 bp; single-stranded, linear
  The letter "N" represents the stem II region of an HH ribozyme.
agucucuucugaugangaaaugaucac

SEQ ID NO: 7197 - DNA, 27 bp; single-stranded, linear
  The letter "N" represents the stem II region of an HH ribozyme.
aagucucucugaugangaaaaugauca

SEQ ID NO: 7198 - DNA, 27 bp; single-stranded, linear
  The letter "N" represents the stem II region of an HH ribozyme.
auuuacuacugaugangaaagucucuu

SEQ ID NO: 7199 - DNA, 27 bp; single-stranded, linear
  The letter "N" represents the stem II region of an HH ribozyme.
cauuuacucugaugangaaaagucucu

SEQ ID NO: 7200 - DNA, 27 bp; single-stranded, linear
  The letter "N" represents the stem II region of an HH ribozyme.
acauuuaccugaugangaaaaagucuc

SEQ ID NO: 7201 - DNA, 27 bp; single-stranded, linear
  The letter "N" represents the stem II region of an HH ribozyme.
gggacauucugaugangaaacuaaagu

SEQ ID NO: 7202 - DNA, 27 bp; single-stranded, linear
  The letter "N" represents the stem II region of an HH ribozyme.
ggaaaaggcugaugangaaacauuuac

SEQ ID NO: 7203 - DNA, 27 bp; single-stranded, linear
  The letter "N" represents the stem II region of an HH ribozyme.
ugugggaacugaugangaaagggacau

SEQ ID NO: 7204 - DNA, 27 bp; single-stranded, linear
  The letter "N" represents the stem II region of an HH ribozyme.
uugugggacugaugangaaaagggaca

SEQ ID NO: 7205 - DNA, 27 bp; single-stranded, linear
  The letter "N" represents the stem II region of an HH ribozyme.
uuugugggcugaugangaaaaagggac

SEQ ID NO: 7206 - DNA, 27 bp; single-stranded, linear
  The letter "N" represents the stem II region of an HH ribozyme.
uuuuguggcugaugangaaaaaaggga

SEQ ID NO: 7207 - DNA, 27 bp; single-stranded, linear
  The letter "N" represents the stem II region of an HH ribozyme.
cuuuucuucugaugangaaacuuuugu

SEQ ID NO: 7208 - DNA, 27 bp; single-stranded, linear
  The letter "N" represents the stem II region of an HH ribozyme.
aaucccgacugaugangaaagcuuuuc

SEQ ID NO: 7209 - DNA, 27 bp; single-stranded, linear
  The letter "N" represents the stem II region of an HH ribozyme.
agaauccccugaugangaaauagcuuu

SEQ ID NO: 7210 - DNA, 27 bp; single-stranded, linear
  The letter "N" represents the stem II region of an HH ribozyme.
aaccagagcugaugangaaaucccgau

SEQ ID NO: 7211 - DNA, 27 bp; single-stranded, linear
  The letter "N" represents the stem II region of an HH ribozyme.
gaaccagacugaugangaaaaucccga

SEQ ID NO: 7212 - DNA, 27 bp; single-stranded, linear
  The letter "N" represents the stem II region of an HH ribozyme.
cagaaccacugaugangaaagaauccc

SEQ ID NO: 7213 - DNA, 27 bp; single-stranded, linear
  The letter "N" represents the stem II region of an HH ribozyme.
uuaagcagcugaugangaaaccagaga

SEQ ID NO: 7214 - DNA, 27 bp; single-stranded, linear
  The letter "N" represents the stem II region of an HH ribozyme.
uuuaagcacugaugangaaaaccagag

SEQ ID NO: 7215 - DNA, 27 bp; single-stranded, linear
  The letter "N" represents the stem II region of an HH ribozyme.
aagucuuucugaugangaaagcagaac

SEQ ID NO: 7216 - DNA, 27 bp; single-stranded, linear
  The letter "N" represents the stem II region of an HH ribozyme.
uaagucuucugaugangaaaagcagaa

SEQ ID NO: 7217 - DNA, 27 bp; single-stranded, linear
  The letter "N" represents the stem II region of an HH ribozyme.
ccaaagcucugaugangaaagucuuua

SEQ ID NO: 7218 - DNA, 27 bp; single-stranded, linear
  The letter "N" represents the stem II region of an HH ribozyme.
uccaaagccugaugangaaaagucuuu

SEQ ID NO: 7219 - DNA, 27 bp; single-stranded, linear
  The letter "N" represents the stem II region of an HH ribozyme.
aggcuccacugaugangaaagcuaagu

SEQ ID NO: 7220 - DNA, 27 bp; single-stranded, linear
  The letter "N" represents the stem II region of an HH ribozyme.
uaggcucccugaugangaaaagcuaag

SEQ ID NO: 7221 - DNA, 27 bp; single-stranded, linear
  The letter "N" represents the stem II region of an HH ribozyme.
aacuuucacugaugangaaaggcucca

SEQ ID NO: 7222 - DNA, 27 bp; single-stranded, linear
  The letter "N" represents the stem II region of an HH ribozyme.
ggcugauccugaugangaaacuuucau

SEQ ID NO: 7223 - DNA, 17 bp; single-stranded, linear
ggccgcgucuugcucac

SEQ ID NO: 7224 - DNA, 17 bp; single-stranded, linear
ccgcgucuugcucacca

SEQ ID NO: 7225 - DNA, 17 bp; single-stranded, linear
gucuugcucaccauggu

SEQ ID NO: 7226 - DNA, 17 bp; single-stranded, linear
accauggucagcugcug

SEQ ID NO: 7227 - DNA, 17 bp; single-stranded, linear
accgcggucuugccuua

SEQ ID NO: 7228 - DNA, 17 bp; single-stranded, linear
cgcggucuugccuuacg

SEQ ID NO: 7229 - DNA, 17 bp; single-stranded, linear
ucuugccuuacgcgcug

SEQ ID NO: 7230 - DNA, 17 bp; single-stranded, linear
cuugccuuacgcgcugc

SEQ ID NO: 7231 - DNA, 17 bp; single-stranded, linear
gcgcugcucgggugucu

SEQ ID NO: 7232 - DNA, 17 bp; single-stranded, linear
ucgggugucugcuucuc

SEQ ID NO: 7233 - DNA, 17 bp; single-stranded, linear
ugucugcuucucacagg

SEQ ID NO: 7234 - DNA, 17 bp; single-stranded, linear
gucugcuucucacagga

SEQ ID NO: 7235 - DNA, 17 bp; single-stranded, linear
cugcuucucacaggaua

SEQ ID NO: 7236 - DNA, 17 bp; single-stranded, linear
cacaggauauggcucag

SEQ ID NO: 7237 - DNA, 17 bp; single-stranded, linear
auauggcucagggucga

SEQ ID NO: 7238 - DNA, 17 bp; single-stranded, linear
cucagggucgaaguuaa

SEQ ID NO: 7239 - DNA, 17 bp; single-stranded, linear
gucgaaguuaaaagugc

SEQ ID NO: 7240 - DNA, 17 bp; single-stranded, linear
ucgaaguuaaaagugcc

SEQ ID NO: 7241 - DNA, 17 bp; single-stranded, linear
aacugaguuuaaaaggc

SEQ ID NO: 7242 - DNA, 17 bp; single-stranded, linear
acugaguuuaaaaggca

SEQ ID NO: 7243 - DNA, 17 bp; single-stranded, linear
cugaguuuaaaaggcac

SEQ ID NO: 7244 - DNA, 17 bp; single-stranded, linear
cagcaugucaugcaagc

SEQ ID NO: 7245 - DNA, 17 bp; single-stranded, linear
gccagacucucuuucuc

SEQ ID NO: 7246 - DNA, 17 bp; single-stranded, linear
cagacucucuuucucaa

SEQ ID NO: 7247 - DNA, 17 bp; single-stranded, linear
gacucucuuucucaagu

SEQ ID NO: 7248 - DNA, 17 bp; single-stranded, linear
acucucuuucucaagug

SEQ ID NO: 7249 - DNA, 17 bp; single-stranded, linear
cucucuuucucaagugc

SEQ ID NO: 7250 - DNA, 17 bp; single-stranded, linear
cucuuucucaagugcag

SEQ ID NO: 7251 - DNA, 17 bp; single-stranded, linear
agcccacucauggucuc

SEQ ID NO: 7252 - DNA, 17 bp; single-stranded, linear
cucauggucucugccca

SEQ ID NO: 7253 - DNA, 17 bp; single-stranded, linear
cauggucucugcccacg

SEQ ID NO: 7254 - DNA, 17 bp; single-stranded, linear
cugagcaucacuccccc

SEQ ID NO: 7255 - DNA, 17 bp; single-stranded, linear
gcaucacucccccaucg

SEQ ID NO: 7256 - DNA, 17 bp; single-stranded, linear
ucccccaucggccugug

SEQ ID NO: 7257 - DNA, 17 bp; single-stranded, linear
ggagggauaacaggcaa

SEQ ID NO: 7258 - DNA, 17 bp; single-stranded, linear
caggcaauucugcagca

SEQ ID NO: 7259 - DNA, 17 bp; single-stranded, linear
aggcaauucugcagcac

SEQ ID NO: 7260 - DNA, 17 bp; single-stranded, linear
cagcaccuugaccuugg

SEQ ID NO: 7261 - DNA, 17 bp; single-stranded, linear
cuugaccuuggacacgg

SEQ ID NO: 7262 - DNA, 17 bp; single-stranded, linear
acgggccucuacaccug

SEQ ID NO: 7263 - DNA, 17 bp; single-stranded, linear
gggccucuacaccugua

SEQ ID NO: 7264 - DNA, 17 bp; single-stranded, linear
acaccuguagauaccuc

SEQ ID NO: 7265 - DNA, 17 bp; single-stranded, linear
cuguagauaccucccua

SEQ ID NO: 7266 - DNA, 17 bp; single-stranded, linear
agauaccucccuacauc

SEQ ID NO: 7267 - DNA, 17 bp; single-stranded, linear
accucccuacaucuacu

SEQ ID NO: 7268 - DNA, 17 bp; single-stranded, linear
cccuacaucuacuucga

SEQ ID NO: 7269 - DNA, 17 bp; single-stranded, linear
cuacaucuacuucgaag

SEQ ID NO: 7270 - DNA, 17 bp; single-stranded, linear
caucuacuucgaagaaa

SEQ ID NO: 7271 - DNA, 17 bp; single-stranded, linear
aucuacuucgaagaaaa

SEQ ID NO: 7272 - DNA, 17 bp; single-stranded, linear
agcggaaucuucaaucu

SEQ ID NO: 7273 - DNA, 17 bp; single-stranded, linear
cggaaucuucaaucuac

SEQ ID NO: 7274 - DNA, 17 bp; single-stranded, linear
ggaaucuucaaucuaca

SEQ ID NO: 7275 - DNA, 17 bp; single-stranded, linear
ucuucaaucuacauauu

SEQ ID NO: 7276 - DNA, 17 bp; single-stranded, linear
uucaaucuacauauuug

SEQ ID NO: 7277 - DNA, 17 bp; single-stranded, linear
aucuacauauuuguuag

SEQ ID NO: 7278 - DNA, 17 bp; single-stranded, linear
cuacauauuuguuagug

SEQ ID NO: 7279 - DNA, 17 bp; single-stranded, linear
uacauauuuguuaguga

SEQ ID NO: 7280 - DNA, 17 bp; single-stranded, linear
auauuuguuagugaugc

SEQ ID NO: 7281 - DNA, 17 bp; single-stranded, linear
uauuuguuagugaugca

SEQ ID NO: 7282 - DNA, 17 bp; single-stranded, linear
cagggaguccuuucaua

SEQ ID NO: 7283 - DNA, 17 bp; single-stranded, linear
ggaguccuuucauagag

SEQ ID NO: 7284 - DNA, 17 bp; single-stranded, linear
gaguccuuucauagaga

SEQ ID NO: 7285 - DNA, 17 bp; single-stranded, linear
aguccuuucauagagau

SEQ ID NO: 7286 - DNA, 17 bp; single-stranded, linear
ccuuucauagagaugca

SEQ ID NO: 7287 - DNA, 17 bp; single-stranded, linear
acugacauacccaaacu

SEQ ID NO: 7288 - DNA, 17 bp; single-stranded, linear
cccaaacuugugcacau

SEQ ID NO: 7289 - DNA, 17 bp; single-stranded, linear
agacagcucaucauccc

SEQ ID NO: 7290 - DNA, 17 bp; single-stranded, linear
cagcucaucauccccug

SEQ ID NO: 7291 - DNA, 17 bp; single-stranded, linear
cucaucauccccugccg

SEQ ID NO: 7292 - DNA, 17 bp; single-stranded, linear
ggugacgucacccaacg

SEQ ID NO: 7293 - DNA, 17 bp; single-stranded, linear
cccaacgucacagucac

SEQ ID NO: 7294 - DNA, 17 bp; single-stranded, linear
gucacagucacccuaaa

SEQ ID NO: 7295 - DNA, 17 bp; single-stranded, linear
gucacccuaaaaaaguu

SEQ ID NO: 7296 - DNA, 17 bp; single-stranded, linear
aaaaaaguuuccauuug

SEQ ID NO: 7297 - DNA, 17 bp; single-stranded, linear
aaaaaguuuccauuuga

SEQ ID NO: 7298 - DNA, 17 bp; single-stranded, linear
aaaaguuuccauuugau

SEQ ID NO: 7299 - DNA, 17 bp; single-stranded, linear
guuuccauuugauacuc

SEQ ID NO: 7300 - DNA, 17 bp; single-stranded, linear
uuuccauuugauacucu

SEQ ID NO: 7301 - DNA, 17 bp; single-stranded, linear
cauuugauacucuuacc

SEQ ID NO: 7302 - DNA, 17 bp; single-stranded, linear
uugauacucuuaccccu

SEQ ID NO: 7303 - DNA, 17 bp; single-stranded, linear
gauacucuuaccccuga

SEQ ID NO: 7304 - DNA, 17 bp; single-stranded, linear
auacucuuaccccugau

SEQ ID NO: 7305 - DNA, 17 bp; single-stranded, linear
caaagaauaacauggga

SEQ ID NO: 7306 - DNA, 17 bp; single-stranded, linear
gggacaguaggagaggc

SEQ ID NO: 7307 - DNA, 17 bp; single-stranded, linear
gagaggcuuuauaauag

SEQ ID NO: 7308 - DNA, 17 bp; single-stranded, linear
agaggcuuuauaauagc

SEQ ID NO: 7309 - DNA, 17 bp; single-stranded, linear
gaggcuuuauaauagca

SEQ ID NO: 7310 - DNA, 17 bp; single-stranded, linear
ggcuuuauaauagcaaa

SEQ ID NO: 7311 - DNA, 17 bp; single-stranded, linear
uuuauaauagcaaaugc

SEQ ID NO: 7312 - DNA, 17 bp; single-stranded, linear
ugcaacguacaaagaga

SEQ ID NO: 7313 - DNA, 17 bp; single-stranded, linear
aaagagauaggacugcu

SEQ ID NO: 7314 - DNA, 17 bp; single-stranded, linear
gccaccgucaacgggca

SEQ ID NO: 7315 - DNA, 17 bp; single-stranded, linear
gcaccuguaccagacaa

SEQ ID NO: 7316 - DNA, 17 bp; single-stranded, linear
gacaaacuaucugaccc

SEQ ID NO: 7317 - DNA, 17 bp; single-stranded, linear
caaacuaucugacccau

SEQ ID NO: 7318 - DNA, 17 bp; single-stranded, linear
ugacccaucggcagacc

SEQ ID NO: 7319 - DNA, 17 bp; single-stranded, linear
agaccaauacaauccua

SEQ ID NO: 7320 - DNA, 17 bp; single-stranded, linear
aauacaauccuagaugu

SEQ ID NO: 7321 - DNA, 17 bp; single-stranded, linear
acaauccuagaugucca

SEQ ID NO: 7322 - DNA, 17 bp; single-stranded, linear
cuagauguccaaauacg

SEQ ID NO: 7323 - DNA, 17 bp; single-stranded, linear
guccaaauacgcccgcc

SEQ ID NO: 7324 - DNA, 17 bp; single-stranded, linear
agacugcuccacgggca

SEQ ID NO: 7325 - DNA, 17 bp; single-stranded, linear
ggcagacucuuguccuc

SEQ ID NO: 7326 - DNA, 17 bp; single-stranded, linear
cagacucuuguccucaa

SEQ ID NO: 7327 - DNA, 17 bp; single-stranded, linear
acucuuguccucaacug

SEQ ID NO: 7328 - DNA, 17 bp; single-stranded, linear
cuuguccucaacugcac

SEQ ID NO: 7329 - DNA, 17 bp; single-stranded, linear
acggagcucaauacgag

SEQ ID NO: 7330 - DNA, 17 bp; single-stranded, linear
agcucaauacgagggug

SEQ ID NO: 7331 - DNA, 17 bp; single-stranded, linear
gcuggaauuacccuggu

SEQ ID NO: 7332 - DNA, 17 bp; single-stranded, linear
cuggaauuacccuggua

SEQ ID NO: 7333 - DNA, 17 bp; single-stranded, linear
acccugguaaagcaacu

SEQ ID NO: 7334 - DNA, 17 bp; single-stranded, linear
aagcaacuaagagagca

SEQ ID NO: 7335 - DNA, 17 bp; single-stranded, linear
gagagcaucuauaaggc

SEQ ID NO: 7336 - DNA, 17 bp; single-stranded, linear
gagcaucuauaaggcag

SEQ ID NO: 7337 - DNA, 17 bp; single-stranded, linear
gcaucuauaaggcagcg

SEQ ID NO: 7338 - DNA, 17 bp; single-stranded, linear
cagcggauugaccggag

SEQ ID NO: 7339 - DNA, 17 bp; single-stranded, linear
ggagccauucccacaac

SEQ ID NO: 7340 - DNA, 17 bp; single-stranded, linear
gagccauucccacaaca

SEQ ID NO: 7341 - DNA, 17 bp; single-stranded, linear
caauguguuccacagug

SEQ ID NO: 7342 - DNA, 17 bp; single-stranded, linear
aauguguuccacagugu

SEQ ID NO: 7343 - DNA, 17 bp; single-stranded, linear
cacaguguucuuaagau

SEQ ID NO: 7344 - DNA, 17 bp; single-stranded, linear
acaguguucuuaagauc

SEQ ID NO: 7345 - DNA, 17 bp; single-stranded, linear
aguguucuuaagaucaa

SEQ ID NO: 7346 - DNA, 17 bp; single-stranded, linear
guguucuuaagaucaac

SEQ ID NO: 7347 - DNA, 17 bp; single-stranded, linear
cuuaagaucaacaaugu

SEQ ID NO: 7348 - DNA, 17 bp; single-stranded, linear
aaggggcucuacaccug

SEQ ID NO: 7349 - DNA, 17 bp; single-stranded, linear
ggggcucuacaccuguc

SEQ ID NO: 7350 - DNA, 17 bp; single-stranded, linear
acaccugucgcgugaag

SEQ ID NO: 7351 - DNA, 17 bp; single-stranded, linear
gaguggguccucguucc

SEQ ID NO: 7352 - DNA, 17 bp; single-stranded, linear
uggguccucguuccagu

SEQ ID NO: 7353 - DNA, 17 bp; single-stranded, linear
guccucguuccagucuu

SEQ ID NO: 7354 - DNA, 17 bp; single-stranded, linear
uccucguuccagucuuu

SEQ ID NO: 7355 - DNA, 17 bp; single-stranded, linear
guuccagucuuucaaca

SEQ ID NO: 7356 - DNA, 17 bp; single-stranded, linear
uccagucuuucaacacc

SEQ ID NO: 7357 - DNA, 17 bp; single-stranded, linear
ccagucuuucaacaccu

SEQ ID NO: 7358 - DNA, 17 bp; single-stranded, linear
cagucuuucaacaccuc

SEQ ID NO: 7359 - DNA, 17 bp; single-stranded, linear
caacaccuccgugcaug

SEQ ID NO: 7360 - DNA, 17 bp; single-stranded, linear
gcauguguaugaaaaag

SEQ ID NO: 7361 - DNA, 17 bp; single-stranded, linear
aaaaggauucaucagug

SEQ ID NO: 7362 - DNA, 17 bp; single-stranded, linear
aaaggauucaucagugu

SEQ ID NO: 7363 - DNA, 17 bp; single-stranded, linear
ggauucaucagugugaa

SEQ ID NO: 7364 - DNA, 17 bp; single-stranded, linear
ugaaacaucggaagcag

SEQ ID NO: 7365 - DNA, 17 bp; single-stranded, linear
aagacgguccuaucggc

SEQ ID NO: 7366 - DNA, 17 bp; single-stranded, linear
acgguccuaucggcugu

SEQ ID NO: 7367 - DNA, 17 bp; single-stranded, linear
gguccuaucggcugucc

SEQ ID NO: 7368 - DNA, 17 bp; single-stranded, linear
ucggcuguccaugaaag

SEQ ID NO: 7369 - DNA, 17 bp; single-stranded, linear
gaaggccuuccccuccc

SEQ ID NO: 7370 - DNA, 17 bp; single-stranded, linear
aaggccuuccccucccc

SEQ ID NO: 7371 - DNA, 17 bp; single-stranded, linear
cuuccccuccccagaaa

SEQ ID NO: 7372 - DNA, 17 bp; single-stranded, linear
ccagaaaucguaugguu

SEQ ID NO: 7373 - DNA, 17 bp; single-stranded, linear
gaaaucguaugguuaaa

SEQ ID NO: 7374 - DNA, 17 bp; single-stranded, linear
cguaugguuaaaagaug

SEQ ID NO: 7375 - DNA, 17 bp; single-stranded, linear
guaugguuaaaagaugg

SEQ ID NO: 7376 - DNA, 17 bp; single-stranded, linear
agauggcucgccugcaa

SEQ ID NO: 7377 - DNA, 17 bp; single-stranded, linear
ugcaacauugaagucug

SEQ ID NO: 7378 - DNA, 17 bp; single-stranded, linear
auugaagucugcucgcu

SEQ ID NO: 7379 - DNA, 17 bp; single-stranded, linear
agucugcucgcuauuug

SEQ ID NO: 7380 - DNA, 17 bp; single-stranded, linear
ugcucgcuauuugguac

SEQ ID NO: 7381 - DNA, 17 bp; single-stranded, linear
cucgcuauuugguacau

SEQ ID NO: 7382 - DNA, 17 bp; single-stranded, linear
ucgcuauuugguacaug

SEQ ID NO: 7383 - DNA, 17 bp; single-stranded, linear
uauuugguacauggcua

SEQ ID NO: 7384 - DNA, 17 bp; single-stranded, linear
acauggcuacucauuaa

SEQ ID NO: 7385 - DNA, 17 bp; single-stranded, linear
uggcuacucauuaauua

SEQ ID NO: 7386 - DNA, 17 bp; single-stranded, linear
cuacucauuaauuauca

SEQ ID NO: 7387 - DNA, 17 bp; single-stranded, linear
uacucauuaauuaucaa

SEQ ID NO: 7388 - DNA, 17 bp; single-stranded, linear
ucauuaauuaucaaaga

SEQ ID NO: 7389 - DNA, 17 bp; single-stranded, linear
cauuaauuaucaaagau

SEQ ID NO: 7390 - DNA, 17 bp; single-stranded, linear
uuaauuaucaaagaugu

SEQ ID NO: 7391 - DNA, 17 bp; single-stranded, linear
aggggacuauacgaucu

SEQ ID NO: 7392 - DNA, 17 bp; single-stranded, linear
gggacuauacgaucuug

SEQ ID NO: 7393 - DNA, 17 bp; single-stranded, linear
uauacgaucuugcuggg

SEQ ID NO: 7394 - DNA, 17 bp; single-stranded, linear
uacgaucuugcugggca

SEQ ID NO: 7395 - DNA, 17 bp; single-stranded, linear
cugggcauaaagcaguc

SEQ ID NO: 7396 - DNA, 17 bp; single-stranded, linear
aaagcagucaaggcuau

SEQ ID NO: 7397 - DNA, 17 bp; single-stranded, linear
ucaaggcuauuuaaaaa

SEQ ID NO: 7398 - DNA, 17 bp; single-stranded, linear
aaggcuauuuaaaaacc

SEQ ID NO: 7399 - DNA, 17 bp; single-stranded, linear
aggcuauuuaaaaaccu

SEQ ID NO: 7400 - DNA, 17 bp; single-stranded, linear
ggcuauuuaaaaaccuc

SEQ ID NO: 7401 - DNA, 17 bp; single-stranded, linear
aaaaaccucacugccac

SEQ ID NO: 7402 - DNA, 17 bp; single-stranded, linear
cugccacucucauugua

SEQ ID NO: 7403 - DNA, 17 bp; single-stranded, linear
gccacucucauuguaaa

SEQ ID NO: 7404 - DNA, 17 bp; single-stranded, linear
acucucauuguaaacgu

SEQ ID NO: 7405 - DNA, 17 bp; single-stranded, linear
cucauuguaaacgugaa

SEQ ID NO: 7406 - DNA, 17 bp; single-stranded, linear
ugaaaccucagaucuac

SEQ ID NO: 7407 - DNA, 17 bp; single-stranded, linear
ccucagaucuacgaaaa

SEQ ID NO: 7408 - DNA, 17 bp; single-stranded, linear
ucagaucuacgaaaagu

SEQ ID NO: 7409 - DNA, 17 bp; single-stranded, linear
cgaaaaguccguguccu

SEQ ID NO: 7410 - DNA, 17 bp; single-stranded, linear
guccguguccucgcuuc

SEQ ID NO: 7411 - DNA, 17 bp; single-stranded, linear
cguguccucgcuuccaa

SEQ ID NO: 7412 - DNA, 17 bp; single-stranded, linear
uccucgcuuccaagccc

SEQ ID NO: 7413 - DNA, 17 bp; single-stranded, linear
ccucgcuuccaagccca

SEQ ID NO: 7414 - DNA, 17 bp; single-stranded, linear
gcccaccucucuauccg

SEQ ID NO: 7415 - DNA, 17 bp; single-stranded, linear
ccaccucucuauccgcu

SEQ ID NO: 7416 - DNA, 17 bp; single-stranded, linear
accucucuauccgcugg

SEQ ID NO: 7417 - DNA, 17 bp; single-stranded, linear
cucucuauccgcugggc

SEQ ID NO: 7418 - DNA, 17 bp; single-stranded, linear
agacaaguccucacuug

SEQ ID NO: 7419 - DNA, 17 bp; single-stranded, linear
caaguccucacuugcac

SEQ ID NO: 7420 - DNA, 17 bp; single-stranded, linear
uccucacuugcaccgug

SEQ ID NO: 7421 - DNA, 17 bp; single-stranded, linear
caccguguauggcaucc

SEQ ID NO: 7422 - DNA, 17 bp; single-stranded, linear
uauggcaucccucggcc

SEQ ID NO: 7423 - DNA, 17 bp; single-stranded, linear
gcaucccucggccaaca

SEQ ID NO: 7424 - DNA, 17 bp; single-stranded, linear
ccaacaaucacguggcu

SEQ ID NO: 7425 - DNA, 17 bp; single-stranded, linear
acguggcucuggcaccc

SEQ ID NO: 7426 - DNA, 17 bp; single-stranded, linear
accccugucaccacaau

SEQ ID NO: 7427 - DNA, 17 bp; single-stranded, linear
accacaaucacuccaaa

SEQ ID NO: 7428 - DNA, 17 bp; single-stranded, linear
caaucacuccaaagaaa

SEQ ID NO: 7429 - DNA, 17 bp; single-stranded, linear
agaaagguaugacuucu

SEQ ID NO: 7430 - DNA, 17 bp; single-stranded, linear
guaugacuucugcacug

SEQ ID NO: 7431 - DNA, 17 bp; single-stranded, linear
uaugacuucugcacuga

SEQ ID NO: 7432 - DNA, 17 bp; single-stranded, linear
ugaagaauccuuuaucc

SEQ ID NO: 7433 - DNA, 17 bp; single-stranded, linear
agaauccuuuauccugg

SEQ ID NO: 7434 - DNA, 17 bp; single-stranded, linear
gaauccuuuauccugga

SEQ ID NO: 7435 - DNA, 17 bp; single-stranded, linear
aauccuuuauccuggau

SEQ ID NO: 7436 - DNA, 17 bp; single-stranded, linear
uccuuuauccuggaucc

SEQ ID NO: 7437 - DNA, 17 bp; single-stranded, linear
uccuggaucccagcagc

SEQ ID NO: 7438 - DNA, 17 bp; single-stranded, linear
cagcaacuuaggaaaca

SEQ ID NO: 7439 - DNA, 17 bp; single-stranded, linear
agcaacuuaggaaacag

SEQ ID NO: 7440 - DNA, 17 bp; single-stranded, linear
aacagaauugagagcau

SEQ ID NO: 7441 - DNA, 17 bp; single-stranded, linear
gagagcaucucucagcg

SEQ ID NO: 7442 - DNA, 17 bp; single-stranded, linear
gagcaucucucagcgca

SEQ ID NO: 7443 - DNA, 17 bp; single-stranded, linear
gcaucucucagcgcaug

SEQ ID NO: 7444 - DNA, 17 bp; single-stranded, linear
augacggucauagaagg

SEQ ID NO: 7445 - DNA, 17 bp; single-stranded, linear
acggucauagaaggaac

SEQ ID NO: 7446 - DNA, 17 bp; single-stranded, linear
gaacaaauaagacgguu

SEQ ID NO: 7447 - DNA, 17 bp; single-stranded, linear
aagacgguuagcacauu

SEQ ID NO: 7448 - DNA, 17 bp; single-stranded, linear
agacgguuagcacauug

SEQ ID NO: 7449 - DNA, 17 bp; single-stranded, linear
uagcacauugguggugg

SEQ ID NO: 7450 - DNA, 17 bp; single-stranded, linear
ggcugacucucagaccc

SEQ ID NO: 7451 - DNA, 17 bp; single-stranded, linear
cugacucucagaccccu

SEQ ID NO: 7452 - DNA, 17 bp; single-stranded, linear
ccuggaaucuacagcug

SEQ ID NO: 7453 - DNA, 17 bp; single-stranded, linear
uggaaucuacagcugcc

SEQ ID NO: 7454 - DNA, 17 bp; single-stranded, linear
ccgggccuucaauaaaa

SEQ ID NO: 7455 - DNA, 17 bp; single-stranded, linear
cgggccuucaauaaaau

SEQ ID NO: 7456 - DNA, 17 bp; single-stranded, linear
ccuucaauaaaauaggg

SEQ ID NO: 7457 - DNA, 17 bp; single-stranded, linear
aauaaaauagggacugu

SEQ ID NO: 7458 - DNA, 17 bp; single-stranded, linear
agaaacauaaaauuuua

SEQ ID NO: 7459 - DNA, 17 bp; single-stranded, linear
cauaaaauuuuauguca

SEQ ID NO: 7460 - DNA, 17 bp; single-stranded, linear
auaaaauuuuaugucac

SEQ ID NO: 7461 - DNA, 17 bp; single-stranded, linear
uaaaauuuuaugucaca

SEQ ID NO: 7462 - DNA, 17 bp; single-stranded, linear
aaaauuuuaugucacag

SEQ ID NO: 7463 - DNA, 17 bp; single-stranded, linear
uuuuaugucacagaugu

SEQ ID NO: 7464 - DNA, 17 bp; single-stranded, linear
gaauggcuuucacguuu

SEQ ID NO: 7465 - DNA, 17 bp; single-stranded, linear
aauggcuuucacguuuc

SEQ ID NO: 7466 - DNA, 17 bp; single-stranded, linear
auggcuuucacguuucc

SEQ ID NO: 7467 - DNA, 17 bp; single-stranded, linear
uuucacguuuccuugga

SEQ ID NO: 7468 - DNA, 17 bp; single-stranded, linear
uucacguuuccuuggaa

SEQ ID NO: 7469 - DNA, 17 bp; single-stranded, linear
ucacguuuccuuggaaa

SEQ ID NO: 7470 - DNA, 17 bp; single-stranded, linear
cguuuccuuggaaaaga

SEQ ID NO: 7471 - DNA, 17 bp; single-stranded, linear
gaaacuguccugugugg

SEQ ID NO: 7472 - DNA, 17 bp; single-stranded, linear
uguguggucaauaaauu

SEQ ID NO: 7473 - DNA, 17 bp; single-stranded, linear
uggucaauaaauuccug

SEQ ID NO: 7474 - DNA, 17 bp; single-stranded, linear
caauaaauuccuguaca

SEQ ID NO: 7475 - DNA, 17 bp; single-stranded, linear
aauaaauuccuguacag

SEQ ID NO: 7476 - DNA, 17 bp; single-stranded, linear
auuccuguacagagaca

SEQ ID NO: 7477 - DNA, 17 bp; single-stranded, linear
agagacauuaccuggau

SEQ ID NO: 7478 - DNA, 17 bp; single-stranded, linear
gagacauuaccuggauu

SEQ ID NO: 7479 - DNA, 17 bp; single-stranded, linear
accuggauucugcuacg

SEQ ID NO: 7480 - DNA, 17 bp; single-stranded, linear
ccuggauucugcuacgg

SEQ ID NO: 7481 - DNA, 17 bp; single-stranded, linear
auucugcuacggacagu

SEQ ID NO: 7482 - DNA, 17 bp; single-stranded, linear
cggacaguuaacaacag

SEQ ID NO: 7483 - DNA, 17 bp; single-stranded, linear
ggacaguuaacaacaga

SEQ ID NO: 7484 - DNA, 17 bp; single-stranded, linear
ugcaccauaguaucagc

SEQ ID NO: 7485 - DNA, 17 bp; single-stranded, linear
accauaguaucagcaag

SEQ ID NO: 7486 - DNA, 17 bp; single-stranded, linear
cauaguaucagcaagca

SEQ ID NO: 7487 - DNA, 17 bp; single-stranded, linear
ccaccacucaagauuac

SEQ ID NO: 7488 - DNA, 17 bp; single-stranded, linear
cucaagauuacuccauc

SEQ ID NO: 7489 - DNA, 17 bp; single-stranded, linear
ucaagauuacuccauca

SEQ ID NO: 7490 - DNA, 17 bp; single-stranded, linear
agauuacuccaucacuc

SEQ ID NO: 7491 - DNA, 17 bp; single-stranded, linear
uacuccaucacucugaa

SEQ ID NO: 7492 - DNA, 17 bp; single-stranded, linear
ccaucacucugaaccuu

SEQ ID NO: 7493 - DNA, 17 bp; single-stranded, linear
cugaaccuugucaucaa

SEQ ID NO: 7494 - DNA, 17 bp; single-stranded, linear
aaccuugucaucaagaa

SEQ ID NO: 7495 - DNA, 17 bp; single-stranded, linear
cuugucaucaagaacgu

SEQ ID NO: 7496 - DNA, 17 bp; single-stranded, linear
gaacgugucucuagaag

SEQ ID NO: 7497 - DNA, 17 bp; single-stranded, linear
acgugucucuagaagac

SEQ ID NO: 7498 - DNA, 17 bp; single-stranded, linear
gugucucuagaagacuc

SEQ ID NO: 7499 - DNA, 17 bp; single-stranded, linear
agaagacucgggcaccu

SEQ ID NO: 7500 - DNA, 17 bp; single-stranded, linear
gggcaccuaugcgugca

SEQ ID NO: 7501 - DNA, 17 bp; single-stranded, linear
aggaacauauacacagg

SEQ ID NO: 7502 - DNA, 17 bp; single-stranded, linear
gaacauauacacagggg

SEQ ID NO: 7503 - DNA, 17 bp; single-stranded, linear
gaagacauccuucggaa

SEQ ID NO: 7504 - DNA, 17 bp; single-stranded, linear
gacauccuucggaagac

SEQ ID NO: 7505 - DNA, 17 bp; single-stranded, linear
acauccuucggaagaca

SEQ ID NO: 7506 - DNA, 17 bp; single-stranded, linear
acagaaguucucguuag

SEQ ID NO: 7507 - DNA, 17 bp; single-stranded, linear
cagaaguucucguuaga

SEQ ID NO: 7508 - DNA, 17 bp; single-stranded, linear
gaaguucucguuagaga

SEQ ID NO: 7509 - DNA, 17 bp; single-stranded, linear
guucucguuagagauuc

SEQ ID NO: 7510 - DNA, 17 bp; single-stranded, linear
uucucguuagagauucg

SEQ ID NO: 7511 - DNA, 17 bp; single-stranded, linear
uuagagauucggaagcg

SEQ ID NO: 7512 - DNA, 17 bp; single-stranded, linear
uagagauucggaagcgc

SEQ ID NO: 7513 - DNA, 17 bp; single-stranded, linear
caccugcuucaaaaccu

SEQ ID NO: 7514 - DNA, 17 bp; single-stranded, linear
accugcuucaaaaccuc

SEQ ID NO: 7515 - DNA, 17 bp; single-stranded, linear
caaaaccucagugacua

SEQ ID NO: 7516 - DNA, 17 bp; single-stranded, linear
cagugacuacgaggucu

SEQ ID NO: 7517 - DNA, 17 bp; single-stranded, linear
uacgaggucuccaucag

SEQ ID NO: 7518 - DNA, 17 bp; single-stranded, linear
cgaggucuccaucagug

SEQ ID NO: 7519 - DNA, 17 bp; single-stranded, linear
gucuccaucaguggcuc

SEQ ID NO: 7520 - DNA, 17 bp; single-stranded, linear
caguggcucuacgaccu

SEQ ID NO: 7521 - DNA, 17 bp; single-stranded, linear
guggcucuacgaccuua

SEQ ID NO: 7522 - DNA, 17 bp; single-stranded, linear
uacgaccuuagacuguc

SEQ ID NO: 7523 - DNA, 17 bp; single-stranded, linear
acgaccuuagacuguca

SEQ ID NO: 7524 - DNA, 17 bp; single-stranded, linear
uagacugucaagcuaga

SEQ ID NO: 7525 - DNA, 17 bp; single-stranded, linear
gucaagcuagagguguc

SEQ ID NO: 7526 - DNA, 17 bp; single-stranded, linear
agagguguccccgcgcc

SEQ ID NO: 7527 - DNA, 17 bp; single-stranded, linear
ccgcgccucagaucacu

SEQ ID NO: 7528 - DNA, 17 bp; single-stranded, linear
ccucagaucacuugguu

SEQ ID NO: 7529 - DNA, 17 bp; single-stranded, linear
agaucacuugguucaaa

SEQ ID NO: 7530 - DNA, 17 bp; single-stranded, linear
cacuugguucaaaaaca

SEQ ID NO: 7531 - DNA, 17 bp; single-stranded, linear
acuugguucaaaaacaa

SEQ ID NO: 7532 - DNA, 17 bp; single-stranded, linear
cacaaaauacaacaaga

SEQ ID NO: 7533 - DNA, 17 bp; single-stranded, linear
ccgggaauuauuuuagg

SEQ ID NO: 7534 - DNA, 17 bp; single-stranded, linear
cgggaauuauuuuagga

SEQ ID NO: 7535 - DNA, 17 bp; single-stranded, linear
ggaauuauuuuaggacc

SEQ ID NO: 7536 - DNA, 17 bp; single-stranded, linear
gaauuauuuuaggacca

SEQ ID NO: 7537 - DNA, 17 bp; single-stranded, linear
aauuauuuuaggaccag

SEQ ID NO: 7538 - DNA, 17 bp; single-stranded, linear
auuauuuuaggaccagg

SEQ ID NO: 7539 - DNA, 17 bp; single-stranded, linear
cacgcuguuuauugaaa

SEQ ID NO: 7540 - DNA, 17 bp; single-stranded, linear
acgcuguuuauugaaag

SEQ ID NO: 7541 - DNA, 17 bp; single-stranded, linear
cgcuguuuauugaaaga

SEQ ID NO: 7542 - DNA, 17 bp; single-stranded, linear
cuguuuauugaaagagu

SEQ ID NO: 7543 - DNA, 17 bp; single-stranded, linear
gaaagagucacagagga

SEQ ID NO: 7544 - DNA, 17 bp; single-stranded, linear
gagggugucuauaggug

SEQ ID NO: 7545 - DNA, 17 bp; single-stranded, linear
gggugucuauaggugcc

SEQ ID NO: 7546 - DNA, 17 bp; single-stranded, linear
gugucuauaggugccga

SEQ ID NO: 7547 - DNA, 17 bp; single-stranded, linear
cgcagccuaccucaccg

SEQ ID NO: 7548 - DNA, 17 bp; single-stranded, linear
gccuaccucaccgugca

SEQ ID NO: 7549 - DNA, 17 bp; single-stranded, linear
aggaaccucagacaagu

SEQ ID NO: 7550 - DNA, 17 bp; single-stranded, linear
agacaagucaaaccugg

SEQ ID NO: 7551 - DNA, 17 bp; single-stranded, linear
gagcugaucacgcucac

SEQ ID NO: 7552 - DNA, 17 bp; single-stranded, linear
aucacgcucacgugcac

SEQ ID NO: 7553 - DNA, 17 bp; single-stranded, linear
gcgacccucuuuuggcu

SEQ ID NO: 7554 - DNA, 17 bp; single-stranded, linear
gacccucuuuuggcucc

SEQ ID NO: 7555 - DNA, 17 bp; single-stranded, linear
acccucuuuuggcuccu

SEQ ID NO: 7556 - DNA, 17 bp; single-stranded, linear
cccucuuuuggcuccuu

SEQ ID NO: 7557 - DNA, 17 bp; single-stranded, linear
uuuuggcuccuucuaac

SEQ ID NO: 7558 - DNA, 17 bp; single-stranded, linear
uggcuccuucuaacucu

SEQ ID NO: 7559 - DNA, 17 bp; single-stranded, linear
ggcuccuucuaacucuc

SEQ ID NO: 7560 - DNA, 17 bp; single-stranded, linear
cuccuucuaacucucuu

SEQ ID NO: 7561 - DNA, 17 bp; single-stranded, linear
uucuaacucucuucauc

SEQ ID NO: 7562 - DNA, 17 bp; single-stranded, linear
cuaacucucuucaucag

SEQ ID NO: 7563 - DNA, 17 bp; single-stranded, linear
aacucucuucaucagaa

SEQ ID NO: 7564 - DNA, 17 bp; single-stranded, linear
acucucuucaucagaaa

SEQ ID NO: 7565 - DNA, 17 bp; single-stranded, linear
cucuucaucagaaaacu

SEQ ID NO: 7566 - DNA, 17 bp; single-stranded, linear
gaagcggucuucuuccg

SEQ ID NO: 7567 - DNA, 17 bp; single-stranded, linear
agcggucuucuuccgaa

SEQ ID NO: 7568 - DNA, 17 bp; single-stranded, linear
gcggucuucuuccgaag

SEQ ID NO: 7569 - DNA, 17 bp; single-stranded, linear
ggucuucuuccgaagua

SEQ ID NO: 7570 - DNA, 17 bp; single-stranded, linear
gucuucuuccgaaguaa

SEQ ID NO: 7571 - DNA, 17 bp; single-stranded, linear
uccgaaguaaagacaga

SEQ ID NO: 7572 - DNA, 17 bp; single-stranded, linear
gacagacuaccugucaa

SEQ ID NO: 7573 - DNA, 17 bp; single-stranded, linear
cuaccugucaaucauua

SEQ ID NO: 7574 - DNA, 17 bp; single-stranded, linear
cugucaaucauuaugga

SEQ ID NO: 7575 - DNA, 17 bp; single-stranded, linear
ucaaucauuauggaccc

SEQ ID NO: 7576 - DNA, 17 bp; single-stranded, linear
caaucauuauggaccca

SEQ ID NO: 7577 - DNA, 17 bp; single-stranded, linear
gaugaaguuccccugga

SEQ ID NO: 7578 - DNA, 17 bp; single-stranded, linear
augaaguuccccuggau

SEQ ID NO: 7579 - DNA, 17 bp; single-stranded, linear
gcugcccuaugaugcca

SEQ ID NO: 7580 - DNA, 17 bp; single-stranded, linear
gugggaguuugcacggg

SEQ ID NO: 7581 - DNA, 17 bp; single-stranded, linear
ugggaguuugcacggga

SEQ ID NO: 7582 - DNA, 17 bp; single-stranded, linear
cugaaacuaggcaaauc

SEQ ID NO: 7583 - DNA, 17 bp; single-stranded, linear
aggcaaaucgcucggaa

SEQ ID NO: 7584 - DNA, 17 bp; single-stranded, linear
aaaucgcucggaagagg

SEQ ID NO: 7585 - DNA, 17 bp; single-stranded, linear
gaggggcuuuugggaaa

SEQ ID NO: 7586 - DNA, 17 bp; single-stranded, linear
aggggcuuuugggaaag

SEQ ID NO: 7587 - DNA, 17 bp; single-stranded, linear
ggggcuuuugggaaagu

SEQ ID NO: 7588 - DNA, 17 bp; single-stranded, linear
gggaaagucguucaagc

SEQ ID NO: 7589 - DNA, 17 bp; single-stranded, linear
aaagucguucaagccuc

SEQ ID NO: 7590 - DNA, 17 bp; single-stranded, linear
aagucguucaagccucu

SEQ ID NO: 7591 - DNA, 17 bp; single-stranded, linear
ucaagccucugcauuug

SEQ ID NO: 7592 - DNA, 17 bp; single-stranded, linear
cucugcauuuggcauua

SEQ ID NO: 7593 - DNA, 17 bp; single-stranded, linear
ucugcauuuggcauuaa

SEQ ID NO: 7594 - DNA, 17 bp; single-stranded, linear
uuuggcauuaagaaauc

SEQ ID NO: 7595 - DNA, 17 bp; single-stranded, linear
uuggcauuaagaaauca

SEQ ID NO: 7596 - DNA, 17 bp; single-stranded, linear
uaagaaaucacccaccu

SEQ ID NO: 7597 - DNA, 17 bp; single-stranded, linear
gaagauguugaaagagg

SEQ ID NO: 7598 - DNA, 17 bp; single-stranded, linear
cagugaguacaaagcuc

SEQ ID NO: 7599 - DNA, 17 bp; single-stranded, linear
acaaagcucugaugacc

SEQ ID NO: 7600 - DNA, 17 bp; single-stranded, linear
accgaacucaagaucuu

SEQ ID NO: 7601 - DNA, 17 bp; single-stranded, linear
cucaagaucuugaccca

SEQ ID NO: 7602 - DNA, 17 bp; single-stranded, linear
caagaucuugacccaca

SEQ ID NO: 7603 - DNA, 17 bp; single-stranded, linear
acccacaucggccauca

SEQ ID NO: 7604 - DNA, 17 bp; single-stranded, linear
ucggccaucaucugaau

SEQ ID NO: 7605 - DNA, 17 bp; single-stranded, linear
gccaucaucugaaugug

SEQ ID NO: 7606 - DNA, 17 bp; single-stranded, linear
aaugugguuaaccuccu

SEQ ID NO: 7607 - DNA, 17 bp; single-stranded, linear
augugguuaaccuccug

SEQ ID NO: 7608 - DNA, 17 bp; single-stranded, linear
guuaaccuccugggagc

SEQ ID NO: 7609 - DNA, 17 bp; single-stranded, linear
gagggccucugauggug

SEQ ID NO: 7610 - DNA, 17 bp; single-stranded, linear
auggugaucguggaaua

SEQ ID NO: 7611 - DNA, 17 bp; single-stranded, linear
cguggaauacugcaaau

SEQ ID NO: 7612 - DNA, 17 bp; single-stranded, linear
cugcaaauacggaaacc

SEQ ID NO: 7613 - DNA, 17 bp; single-stranded, linear
aaaccuguccaacuacc

SEQ ID NO: 7614 - DNA, 17 bp; single-stranded, linear
guccaacuaccucaaga

SEQ ID NO: 7615 - DNA, 17 bp; single-stranded, linear
aacuaccucaagagcaa

SEQ ID NO: 7616 - DNA, 17 bp; single-stranded, linear
acgugacuuauucuguc

SEQ ID NO: 7617 - DNA, 17 bp; single-stranded, linear
cgugacuuauucugucu

SEQ ID NO: 7618 - DNA, 17 bp; single-stranded, linear
ugacuuauucugucuca

SEQ ID NO: 7619 - DNA, 17 bp; single-stranded, linear
gacuuauucugucucaa

SEQ ID NO: 7620 - DNA, 17 bp; single-stranded, linear
uauucugucucaacaag

SEQ ID NO: 7621 - DNA, 17 bp; single-stranded, linear
uucugucucaacaagga

SEQ ID NO: 7622 - DNA, 17 bp; single-stranded, linear
cgcagccuugcauaugg

SEQ ID NO: 7623 - DNA, 17 bp; single-stranded, linear
ccuugcauauggagcuc

SEQ ID NO: 7624 - DNA, 17 bp; single-stranded, linear
auggagcucaagaaaga

SEQ ID NO: 7625 - DNA, 17 bp; single-stranded, linear
ccccgccuagacagugu

SEQ ID NO: 7626 - DNA, 17 bp; single-stranded, linear
gacagugucagcagcuc

SEQ ID NO: 7627 - DNA, 17 bp; single-stranded, linear
cagcagcucaaguguca

SEQ ID NO: 7628 - DNA, 17 bp; single-stranded, linear
ucaagugucaccagcuc

SEQ ID NO: 7629 - DNA, 17 bp; single-stranded, linear
caccagcuccagcuucc

SEQ ID NO: 7630 - DNA, 17 bp; single-stranded, linear
cuccagcuucccugaag

SEQ ID NO: 7631 - DNA, 17 bp; single-stranded, linear
uccagcuucccugaaga

SEQ ID NO: 7632 - DNA, 17 bp; single-stranded, linear
acgaggauuacagugag

SEQ ID NO: 7633 - DNA, 17 bp; single-stranded, linear
cgaggauuacagugaga

SEQ ID NO: 7634 - DNA, 17 bp; single-stranded, linear
agugagaucuccaagca

SEQ ID NO: 7635 - DNA, 17 bp; single-stranded, linear
ugagaucuccaagcagc

SEQ ID NO: 7636 - DNA, 17 bp; single-stranded, linear
cagccccucaccaugga

SEQ ID NO: 7637 - DNA, 17 bp; single-stranded, linear
gaccugauuuccuacag

SEQ ID NO: 7638 - DNA, 17 bp; single-stranded, linear
accugauuuccuacagu

SEQ ID NO: 7639 - DNA, 17 bp; single-stranded, linear
ccugauuuccuacaguu

SEQ ID NO: 7640 - DNA, 17 bp; single-stranded, linear
gauuuccuacaguuucc

SEQ ID NO: 7641 - DNA, 17 bp; single-stranded, linear
ccuacaguuuccaagug

SEQ ID NO: 7642 - DNA, 17 bp; single-stranded, linear
cuacaguuuccaagugg

SEQ ID NO: 7643 - DNA, 17 bp; single-stranded, linear
uacaguuuccaaguggc

SEQ ID NO: 7644 - DNA, 17 bp; single-stranded, linear
cauggaguuucuguccu

SEQ ID NO: 7645 - DNA, 17 bp; single-stranded, linear
auggaguuucuguccuc

SEQ ID NO: 7646 - DNA, 17 bp; single-stranded, linear
uggaguuucuguccucc

SEQ ID NO: 7647 - DNA, 17 bp; single-stranded, linear
guuucuguccuccagaa

SEQ ID NO: 7648 - DNA, 17 bp; single-stranded, linear
ucuguccuccagaaagu

SEQ ID NO: 7649 - DNA, 17 bp; single-stranded, linear
aagugcauucaucggga

SEQ ID NO: 7650 - DNA, 17 bp; single-stranded, linear
agugcauucaucgggac

SEQ ID NO: 7651 - DNA, 17 bp; single-stranded, linear
gcauucaucgggaccug

SEQ ID NO: 7652 - DNA, 17 bp; single-stranded, linear
agaaacauccuuuuauc

SEQ ID NO: 7653 - DNA, 17 bp; single-stranded, linear
aacauccuuuuaucuga

SEQ ID NO: 7654 - DNA, 17 bp; single-stranded, linear
acauccuuuuaucugag

SEQ ID NO: 7655 - DNA, 17 bp; single-stranded, linear
cauccuuuuaucugaga

SEQ ID NO: 7656 - DNA, 17 bp; single-stranded, linear
auccuuuuaucugagaa

SEQ ID NO: 7657 - DNA, 17 bp; single-stranded, linear
ccuuuuaucugagaaca

SEQ ID NO: 7658 - DNA, 17 bp; single-stranded, linear
gugaagauuugcgacuu

SEQ ID NO: 7659 - DNA, 17 bp; single-stranded, linear
ugaagauuugcgacuuu

SEQ ID NO: 7660 - DNA, 17 bp; single-stranded, linear
uugcgacuuuggccugg

SEQ ID NO: 7661 - DNA, 17 bp; single-stranded, linear
ugcgacuuuggccuggc

SEQ ID NO: 7662 - DNA, 17 bp; single-stranded, linear
cccgggauauuuauaag

SEQ ID NO: 7663 - DNA, 17 bp; single-stranded, linear
cgggauauuuauaagaa

SEQ ID NO: 7664 - DNA, 17 bp; single-stranded, linear
gggauauuuauaagaac

SEQ ID NO: 7665 - DNA, 17 bp; single-stranded, linear
ggauauuuauaagaacc

SEQ ID NO: 7666 - DNA, 17 bp; single-stranded, linear
auauuuauaagaacccu

SEQ ID NO: 7667 - DNA, 17 bp; single-stranded, linear
acccugauuaugugagg

SEQ ID NO: 7668 - DNA, 17 bp; single-stranded, linear
cccugauuaugugagga

SEQ ID NO: 7669 - DNA, 17 bp; single-stranded, linear
gaggagauacucgacuu

SEQ ID NO: 7670 - DNA, 17 bp; single-stranded, linear
gagauacucgacuuccc

SEQ ID NO: 7671 - DNA, 17 bp; single-stranded, linear
acucgacuuccccuaaa

SEQ ID NO: 7672 - DNA, 17 bp; single-stranded, linear
cucgacuuccccuaaaa

SEQ ID NO: 7673 - DNA, 17 bp; single-stranded, linear
cuuccccuaaaauggau

SEQ ID NO: 7674 - DNA, 17 bp; single-stranded, linear
ggauggcuccugaaucc

SEQ ID NO: 7675 - DNA, 17 bp; single-stranded, linear
uccugaauccaucuuug

SEQ ID NO: 7676 - DNA, 17 bp; single-stranded, linear
gaauccaucuuugacaa

SEQ ID NO: 7677 - DNA, 17 bp; single-stranded, linear
auccaucuuugacaagg

SEQ ID NO: 7678 - DNA, 17 bp; single-stranded, linear
uccaucuuugacaaggu

SEQ ID NO: 7679 - DNA, 17 bp; single-stranded, linear
gacaaggucuacagcac

SEQ ID NO: 7680 - DNA, 17 bp; single-stranded, linear
caaggucuacagcacca

SEQ ID NO: 7681 - DNA, 17 bp; single-stranded, linear
ugugugguccuauggcg

SEQ ID NO: 7682 - DNA, 17 bp; single-stranded, linear
gugguccuauggcgugu

SEQ ID NO: 7683 - DNA, 17 bp; single-stranded, linear
uggcguguugcuguggg

SEQ ID NO: 7684 - DNA, 17 bp; single-stranded, linear
ugggagaucuucuccuu

SEQ ID NO: 7685 - DNA, 17 bp; single-stranded, linear
ggagaucuucuccuuag

SEQ ID NO: 7686 - DNA, 17 bp; single-stranded, linear
gagaucuucuccuuagg

SEQ ID NO: 7687 - DNA, 17 bp; single-stranded, linear
gaucuucuccuuagggg

SEQ ID NO: 7688 - DNA, 17 bp; single-stranded, linear
cuucuccuuaggggguu

SEQ ID NO: 7689 - DNA, 17 bp; single-stranded, linear
uucuccuuaggggguuc

SEQ ID NO: 7690 - DNA, 17 bp; single-stranded, linear
uaggggguucuccauac

SEQ ID NO: 7691 - DNA, 17 bp; single-stranded, linear
aggggguucuccauacc

SEQ ID NO: 7692 - DNA, 17 bp; single-stranded, linear
gggguucuccauaccca

SEQ ID NO: 7693 - DNA, 17 bp; single-stranded, linear
uucuccauacccaggag

SEQ ID NO: 7694 - DNA, 17 bp; single-stranded, linear
ugaagacuucugcagcc

SEQ ID NO: 7695 - DNA, 17 bp; single-stranded, linear
gaagacuucugcagccg

SEQ ID NO: 7696 - DNA, 17 bp; single-stranded, linear
cccggaguaugccacac

SEQ ID NO: 7697 - DNA, 17 bp; single-stranded, linear
ccugaaaucuaccaaau

SEQ ID NO: 7698 - DNA, 17 bp; single-stranded, linear
ugaaaucuaccaaauca

SEQ ID NO: 7699 - DNA, 17 bp; single-stranded, linear
uaccaaaucauguugga

SEQ ID NO: 7700 - DNA, 17 bp; single-stranded, linear
aaucauguuggauugcu

SEQ ID NO: 7701 - DNA, 17 bp; single-stranded, linear
uguuggauugcuggcac

SEQ ID NO: 7702 - DNA, 17 bp; single-stranded, linear
gccccgguuugcugaac

SEQ ID NO: 7703 - DNA, 17 bp; single-stranded, linear
ccccgguuugcugaacu

SEQ ID NO: 7704 - DNA, 17 bp; single-stranded, linear
gcugaacuuguggagaa

SEQ ID NO: 7705 - DNA, 17 bp; single-stranded, linear
gagaaacuuggugaccu

SEQ ID NO: 7706 - DNA, 17 bp; single-stranded, linear
gaccugcuucaagccaa

SEQ ID NO: 7707 - DNA, 17 bp; single-stranded, linear
accugcuucaagccaac

SEQ ID NO: 7708 - DNA, 17 bp; single-stranded, linear
gccaacguccaacagga

SEQ ID NO: 7709 - DNA, 17 bp; single-stranded, linear
ggaaagauuacaucccc

SEQ ID NO: 7710 - DNA, 17 bp; single-stranded, linear
gaaagauuacauccccc

SEQ ID NO: 7711 - DNA, 17 bp; single-stranded, linear
gauuacaucccccucaa

SEQ ID NO: 7712 - DNA, 17 bp; single-stranded, linear
aucccccucaaugccau

SEQ ID NO: 7713 - DNA, 17 bp; single-stranded, linear
aaugccauacugacuag

SEQ ID NO: 7714 - DNA, 17 bp; single-stranded, linear
uacugacuagaaacagu

SEQ ID NO: 7715 - DNA, 17 bp; single-stranded, linear
gaaacaguagcuucaca

SEQ ID NO: 7716 - DNA, 17 bp; single-stranded, linear
caguagcuucacauacu

SEQ ID NO: 7717 - DNA, 17 bp; single-stranded, linear
aguagcuucacauacuc

SEQ ID NO: 7718 - DNA, 17 bp; single-stranded, linear
cuucacauacucgaccc

SEQ ID NO: 7719 - DNA, 17 bp; single-stranded, linear
cacauacucgaccccca

SEQ ID NO: 7720 - DNA, 17 bp; single-stranded, linear
ccccaccuucucugagg

SEQ ID NO: 7721 - DNA, 17 bp; single-stranded, linear
cccaccuucucugagga

SEQ ID NO: 7722 - DNA, 17 bp; single-stranded, linear
caccuucucugaggacc

SEQ ID NO: 7723 - DNA, 17 bp; single-stranded, linear
gaggaccuuuucaagga

SEQ ID NO: 7724 - DNA, 17 bp; single-stranded, linear
aggaccuuuucaaggac

SEQ ID NO: 7725 - DNA, 17 bp; single-stranded, linear
ggaccuuuucaaggacg

SEQ ID NO: 7726 - DNA, 17 bp; single-stranded, linear
gaccuuuucaaggacgg

SEQ ID NO: 7727 - DNA, 17 bp; single-stranded, linear
ggacggcuuugcagauc

SEQ ID NO: 7728 - DNA, 17 bp; single-stranded, linear
gacggcuuugcagaucc

SEQ ID NO: 7729 - DNA, 17 bp; single-stranded, linear
uugcagauccacauuuu

SEQ ID NO: 7730 - DNA, 17 bp; single-stranded, linear
auccacauuuucauucc

SEQ ID NO: 7731 - DNA, 17 bp; single-stranded, linear
uccacauuuucauuccg

SEQ ID NO: 7732 - DNA, 17 bp; single-stranded, linear
ccacauuuucauuccgg

SEQ ID NO: 7733 - DNA, 17 bp; single-stranded, linear
cacauuuucauuccgga

SEQ ID NO: 7734 - DNA, 17 bp; single-stranded, linear
auuuucauuccggaagc

SEQ ID NO: 7735 - DNA, 17 bp; single-stranded, linear
uuuucauuccggaagcu

SEQ ID NO: 7736 - DNA, 17 bp; single-stranded, linear
cggaagcucugaugaug

SEQ ID NO: 7737 - DNA, 17 bp; single-stranded, linear
ugugagauauguaaacg

SEQ ID NO: 7738 - DNA, 17 bp; single-stranded, linear
agauauguaaacgcuuu

SEQ ID NO: 7739 - DNA, 17 bp; single-stranded, linear
uaaacgcuuucaaauuc

SEQ ID NO: 7740 - DNA, 17 bp; single-stranded, linear
aaacgcuuucaaauuca

SEQ ID NO: 7741 - DNA, 17 bp; single-stranded, linear
aacgcuuucaaauucau

SEQ ID NO: 7742 - DNA, 17 bp; single-stranded, linear
uuucaaauucaugagcc

SEQ ID NO: 7743 - DNA, 17 bp; single-stranded, linear
uucaaauucaugagccu

SEQ ID NO: 7744 - DNA, 17 bp; single-stranded, linear
gaaagaaucaaaaccuu

SEQ ID NO: 7745 - DNA, 17 bp; single-stranded, linear
caaaaccuuugaggagc

SEQ ID NO: 7746 - DNA, 17 bp; single-stranded, linear
aaaaccuuugaggagcu

SEQ ID NO: 7747 - DNA, 17 bp; single-stranded, linear
gaggagcuuucaccgaa

SEQ ID NO: 7748 - DNA, 17 bp; single-stranded, linear
aggagcuuucaccgaac

SEQ ID NO: 7749 - DNA, 17 bp; single-stranded, linear
ggagcuuucaccgaacu

SEQ ID NO: 7750 - DNA, 17 bp; single-stranded, linear
accgaacuccaccucca

SEQ ID NO: 7751 - DNA, 17 bp; single-stranded, linear
cuccaccuccauguuug

SEQ ID NO: 7752 - DNA, 17 bp; single-stranded, linear
cuccauguuugaggacu

SEQ ID NO: 7753 - DNA, 17 bp; single-stranded, linear
uccauguuugaggacua

SEQ ID NO: 7754 - DNA, 17 bp; single-stranded, linear
ugaggacuaucagcugg

SEQ ID NO: 7755 - DNA, 17 bp; single-stranded, linear
aggacuaucagcuggac

SEQ ID NO: 7756 - DNA, 17 bp; single-stranded, linear
uggacacuagcacucug

SEQ ID NO: 7757 - DNA, 17 bp; single-stranded, linear
cuagcacucugcugggc

SEQ ID NO: 7758 - DNA, 17 bp; single-stranded, linear
gcugggcucccccuugc

SEQ ID NO: 7759 - DNA, 17 bp; single-stranded, linear
cucccccuugcugaagc

SEQ ID NO: 7760 - DNA, 17 bp; single-stranded, linear
gaagcgguucaccugga

SEQ ID NO: 7761 - DNA, 17 bp; single-stranded, linear
aagcgguucaccuggac

SEQ ID NO: 7762 - DNA, 17 bp; single-stranded, linear
caaggccuccaugaaga

SEQ ID NO: 7763 - DNA, 17 bp; single-stranded, linear
augaagauagacuugag

SEQ ID NO: 7764 - DNA, 17 bp; single-stranded, linear
gauagacuugagaauag

SEQ ID NO: 7765 - DNA, 17 bp; single-stranded, linear
uugagaauagcgaguaa

SEQ ID NO: 7766 - DNA, 17 bp; single-stranded, linear
uagcgaguaaaagcaag

SEQ ID NO: 7767 - DNA, 17 bp; single-stranded, linear
gcgggacuuuccgaucu

SEQ ID NO: 7768 - DNA, 17 bp; single-stranded, linear
cgggacuuuccgaucug

SEQ ID NO: 7769 - DNA, 17 bp; single-stranded, linear
gggacuuuccgaucugc

SEQ ID NO: 7770 - DNA, 17 bp; single-stranded, linear
uuuccgaucugccgagg

SEQ ID NO: 7771 - DNA, 17 bp; single-stranded, linear
gcccagcuucugcuucu

SEQ ID NO: 7772 - DNA, 17 bp; single-stranded, linear
cccagcuucugcuucuc

SEQ ID NO: 7773 - DNA, 17 bp; single-stranded, linear
cuucugcuucuccagcu

SEQ ID NO: 7774 - DNA, 17 bp; single-stranded, linear
uucugcuucuccagcug

SEQ ID NO: 7775 - DNA, 17 bp; single-stranded, linear
cugcuucuccagcugug

SEQ ID NO: 7776 - DNA, 17 bp; single-stranded, linear
ggccacaucaggcccgu

SEQ ID NO: 7777 - DNA, 17 bp; single-stranded, linear
cgaugaaucugagcugg

SEQ ID NO: 7778 - DNA, 17 bp; single-stranded, linear
aaaggaguccugcuguu

SEQ ID NO: 7779 - DNA, 17 bp; single-stranded, linear
ccugcuguucuccaccc

SEQ ID NO: 7780 - DNA, 17 bp; single-stranded, linear
cugcuguucuccacccc

SEQ ID NO: 7781 - DNA, 17 bp; single-stranded, linear
gcuguucuccaccccca

SEQ ID NO: 7782 - DNA, 17 bp; single-stranded, linear
cccagacuacaacuccg

SEQ ID NO: 7783 - DNA, 17 bp; single-stranded, linear
cuacaacuccguggugu

SEQ ID NO: 7784 - DNA, 17 bp; single-stranded, linear
cgugguguuguacuccu

SEQ ID NO: 7785 - DNA, 17 bp; single-stranded, linear
gguguuguacuccuccc

SEQ ID NO: 7786 - DNA, 17 bp; single-stranded, linear
guuguacuccuccccgc

SEQ ID NO: 7787 - DNA, 17 bp; single-stranded, linear
guacuccuccccgcccg

SEQ ID NO: 7788 - DNA, 17 bp; single-stranded, linear
gcccgccuaaagcuucu

SEQ ID NO: 7789 - DNA, 17 bp; single-stranded, linear
cuaaagcuucucaccag

SEQ ID NO: 7790 - DNA, 17 bp; single-stranded, linear
uaaagcuucucaccagc

SEQ ID NO: 7791 - DNA, 17 bp; single-stranded, linear
aagcuucucaccagccc

SEQ ID NO: 7792 - DNA, 17 bp; single-stranded, linear
cugacaguauuauacau

SEQ ID NO: 7793 - DNA, 17 bp; single-stranded, linear
gacaguauuauacaucu

SEQ ID NO: 7794 - DNA, 17 bp; single-stranded, linear
acaguauuauacaucua

SEQ ID NO: 7795 - DNA, 17 bp; single-stranded, linear
aguauuauacaucuaug

SEQ ID NO: 7796 - DNA, 17 bp; single-stranded, linear
uuauacaucuaugaguu

SEQ ID NO: 7797 - DNA, 17 bp; single-stranded, linear
auacaucuaugaguuua

SEQ ID NO: 7798 - DNA, 17 bp; single-stranded, linear
cuaugaguuuacaccua

SEQ ID NO: 7799 - DNA, 17 bp; single-stranded, linear
uaugaguuuacaccuau

SEQ ID NO: 7800 - DNA, 17 bp; single-stranded, linear
augaguuuacaccuauu

SEQ ID NO: 7801 - DNA, 17 bp; single-stranded, linear
uuacaccuauuccgcuc

SEQ ID NO: 7802 - DNA, 17 bp; single-stranded, linear
acaccuauuccgcucca

SEQ ID NO: 7803 - DNA, 17 bp; single-stranded, linear
caccuauuccgcuccac

SEQ ID NO: 7804 - DNA, 17 bp; single-stranded, linear
auuccgcuccacaggag

SEQ ID NO: 7805 - DNA, 17 bp; single-stranded, linear
cagcugcuuuucgugac

SEQ ID NO: 7806 - DNA, 17 bp; single-stranded, linear
agcugcuuuucgugacc

SEQ ID NO: 7807 - DNA, 17 bp; single-stranded, linear
gcugcuuuucgugaccu

SEQ ID NO: 7808 - DNA, 17 bp; single-stranded, linear
cugcuuuucgugaccuu

SEQ ID NO: 7809 - DNA, 17 bp; single-stranded, linear
cgugaccuuuaaucgug

SEQ ID NO: 7810 - DNA, 17 bp; single-stranded, linear
gugaccuuuaaucgugc

SEQ ID NO: 7811 - DNA, 17 bp; single-stranded, linear
ugaccuuuaaucgugcu

SEQ ID NO: 7812 - DNA, 17 bp; single-stranded, linear
ccuuuaaucgugcuuuu

SEQ ID NO: 7813 - DNA, 17 bp; single-stranded, linear
aucgugcuuuuuuguuu

SEQ ID NO: 7814 - DNA, 17 bp; single-stranded, linear
ucgugcuuuuuuguuuu

SEQ ID NO: 7815 - DNA, 17 bp; single-stranded, linear
cgugcuuuuuuguuuuu

SEQ ID NO: 7816 - DNA, 17 bp; single-stranded, linear
gugcuuuuuuguuuuuu

SEQ ID NO: 7817 - DNA, 17 bp; single-stranded, linear
ugcuuuuuuguuuuuug

SEQ ID NO: 7818 - DNA, 17 bp; single-stranded, linear
uuuuuuguuuuuuguuu

SEQ ID NO: 7819 - DNA, 17 bp; single-stranded, linear
uuuuuguuuuuuguuuu

SEQ ID NO: 7820 - DNA, 17 bp; single-stranded, linear
uuuuguuuuuuguuuug

SEQ ID NO: 7821 - DNA, 17 bp; single-stranded, linear
uuuguuuuuuguuuugu

SEQ ID NO: 7822 - DNA, 17 bp; single-stranded, linear
uuguuuuuuguuuuguu

SEQ ID NO: 7823 - DNA, 17 bp; single-stranded, linear
uuuuuuguuuuguuugu

SEQ ID NO: 7824 - DNA, 17 bp; single-stranded, linear
uuuuuguuuuguuuguu

SEQ ID NO: 7825 - DNA, 17 bp; single-stranded, linear
uuuuguuuuguuuguug

SEQ ID NO: 7826 - DNA, 17 bp; single-stranded, linear
uguuuuguuuguuguug

SEQ ID NO: 7827 - DNA, 17 bp; single-stranded, linear
guuuuguuuguuguugc

SEQ ID NO: 7828 - DNA, 17 bp; single-stranded, linear
uuguuuguuguugcugu

SEQ ID NO: 7829 - DNA, 17 bp; single-stranded, linear
uuuguuguugcuguuuu

SEQ ID NO: 7830 - DNA, 17 bp; single-stranded, linear
guugcuguuuugacuaa

SEQ ID NO: 7831 - DNA, 17 bp; single-stranded, linear
uugcuguuuugacuaac

SEQ ID NO: 7832 - DNA, 17 bp; single-stranded, linear
ugcuguuuugacuaaca

SEQ ID NO: 7833 - DNA, 17 bp; single-stranded, linear
uuuugacuaacaagaau

SEQ ID NO: 7834 - DNA, 17 bp; single-stranded, linear
aagaauguaaccccagu

SEQ ID NO: 7835 - DNA, 17 bp; single-stranded, linear
accccaguuagugacgu

SEQ ID NO: 7836 - DNA, 17 bp; single-stranded, linear
ccccaguuagugacgug

SEQ ID NO: 7837 - DNA, 17 bp; single-stranded, linear
ugaagaauacuauuguu

SEQ ID NO: 7838 - DNA, 17 bp; single-stranded, linear
agaauacuauuguuaga

SEQ ID NO: 7839 - DNA, 17 bp; single-stranded, linear
aauacuauuguuagaga

SEQ ID NO: 7840 - DNA, 17 bp; single-stranded, linear
acuauuguuagagaaau

SEQ ID NO: 7841 - DNA, 17 bp; single-stranded, linear
cuauuguuagagaaauc

SEQ ID NO: 7842 - DNA, 17 bp; single-stranded, linear
agagaaaucccccccgc

SEQ ID NO: 7843 - DNA, 17 bp; single-stranded, linear
caaagccucaggguaac

SEQ ID NO: 7844 - DNA, 17 bp; single-stranded, linear
cucaggguaaccuggac

SEQ ID NO: 7845 - DNA, 17 bp; single-stranded, linear
aggugccucuggcgacc

SEQ ID NO: 7846 - DNA, 17 bp; single-stranded, linear
cccacccucccugcagc

SEQ ID NO: 7847 - DNA, 17 bp; single-stranded, linear
gugggacuagaggcagu

SEQ ID NO: 7848 - DNA, 17 bp; single-stranded, linear
gaggcaguaagcccauu

SEQ ID NO: 7849 - DNA, 17 bp; single-stranded, linear
aagcccauuagcucaug

SEQ ID NO: 7850 - DNA, 17 bp; single-stranded, linear
agcccauuagcucaugg

SEQ ID NO: 7851 - DNA, 17 bp; single-stranded, linear
cauuagcucauggcugc

SEQ ID NO: 7852 - DNA, 17 bp; single-stranded, linear
gaccugcucugucucuc

SEQ ID NO: 7853 - DNA, 17 bp; single-stranded, linear
ugcucugucucucuuau

SEQ ID NO: 7854 - DNA, 17 bp; single-stranded, linear
cucugucucucuuaugg

SEQ ID NO: 7855 - DNA, 17 bp; single-stranded, linear
cugucucucuuauggag

SEQ ID NO: 7856 - DNA, 17 bp; single-stranded, linear
gucucucuuauggagga

SEQ ID NO: 7857 - DNA, 17 bp; single-stranded, linear
ucucucuuauggaggaa

SEQ ID NO: 7858 - DNA, 17 bp; single-stranded, linear
aaaaggcuuugggaugc

SEQ ID NO: 7859 - DNA, 17 bp; single-stranded, linear
aaaggcuuugggaugcg

SEQ ID NO: 7860 - DNA, 17 bp; single-stranded, linear
ggaugcguccguccugu

SEQ ID NO: 7861 - DNA, 17 bp; single-stranded, linear
gcguccguccuguggag

SEQ ID NO: 7862 - DNA, 17 bp; single-stranded, linear
agggggcuccgcuaugc

SEQ ID NO: 7863 - DNA, 17 bp; single-stranded, linear
gcuccgcuaugccacuu

SEQ ID NO: 7864 - DNA, 17 bp; single-stranded, linear
augccacuucagugacu

SEQ ID NO: 7865 - DNA, 17 bp; single-stranded, linear
ugccacuucagugacuu

SEQ ID NO: 7866 - DNA, 17 bp; single-stranded, linear
cagugacuucucacucc

SEQ ID NO: 7867 - DNA, 17 bp; single-stranded, linear
agugacuucucacuccu

SEQ ID NO: 7868 - DNA, 17 bp; single-stranded, linear
ugacuucucacuccugg

SEQ ID NO: 7869 - DNA, 17 bp; single-stranded, linear
uucucacuccuggccuc

SEQ ID NO: 7870 - DNA, 17 bp; single-stranded, linear
ccuggccuccgcuguuu

SEQ ID NO: 7871 - DNA, 17 bp; single-stranded, linear
uccgcuguuucgggccc

SEQ ID NO: 7872 - DNA, 17 bp; single-stranded, linear
ccgcuguuucgggcccc

SEQ ID NO: 7873 - DNA, 17 bp; single-stranded, linear
cgcuguuucgggccccc

SEQ ID NO: 7874 - DNA, 17 bp; single-stranded, linear
ggcccccuuccaagagg

SEQ ID NO: 7875 - DNA, 17 bp; single-stranded, linear
gcccccuuccaagaggu

SEQ ID NO: 7876 - DNA, 17 bp; single-stranded, linear
caagagguaucagagca

SEQ ID NO: 7877 - DNA, 17 bp; single-stranded, linear
agagguaucagagcaga

SEQ ID NO: 7878 - DNA, 17 bp; single-stranded, linear
agggacguuuccuagac

SEQ ID NO: 7879 - DNA, 17 bp; single-stranded, linear
gggacguuuccuagacc

SEQ ID NO: 7880 - DNA, 17 bp; single-stranded, linear
ggacguuuccuagacca

SEQ ID NO: 7881 - DNA, 17 bp; single-stranded, linear
cguuuccuagaccaggg

SEQ ID NO: 7882 - DNA, 17 bp; single-stranded, linear
gcacauguucucgggaa

SEQ ID NO: 7883 - DNA, 17 bp; single-stranded, linear
cacauguucucgggaac

SEQ ID NO: 7884 - DNA, 17 bp; single-stranded, linear
cauguucucgggaacca

SEQ ID NO: 7885 - DNA, 17 bp; single-stranded, linear
accacaguuaaucuuaa

SEQ ID NO: 7886 - DNA, 17 bp; single-stranded, linear
ccacaguuaaucuuaaa

SEQ ID NO: 7887 - DNA, 17 bp; single-stranded, linear
caguuaaucuuaaaucu

SEQ ID NO: 7888 - DNA, 17 bp; single-stranded, linear
guuaaucuuaaaucuuu

SEQ ID NO: 7889 - DNA, 17 bp; single-stranded, linear
uuaaucuuaaaucuuuu

SEQ ID NO: 7890 - DNA, 17 bp; single-stranded, linear
ucuuaaaucuuuucccg

SEQ ID NO: 7891 - DNA, 17 bp; single-stranded, linear
uuaaaucuuuucccggg

SEQ ID NO: 7892 - DNA, 17 bp; single-stranded, linear
uaaaucuuuucccggga

SEQ ID NO: 7893 - DNA, 17 bp; single-stranded, linear
aaaucuuuucccgggag

SEQ ID NO: 7894 - DNA, 17 bp; single-stranded, linear
aaucuuuucccgggagu

SEQ ID NO: 7895 - DNA, 17 bp; single-stranded, linear
ccgggagucuucuguug

SEQ ID NO: 7896 - DNA, 17 bp; single-stranded, linear
gggagucuucuguuguc

SEQ ID NO: 7897 - DNA, 17 bp; single-stranded, linear
ggagucuucuguugucu

SEQ ID NO: 7898 - DNA, 17 bp; single-stranded, linear
ucuucuguugucuguuu

SEQ ID NO: 7899 - DNA, 17 bp; single-stranded, linear
ucuguugucuguuuacc

SEQ ID NO: 7900 - DNA, 17 bp; single-stranded, linear
uugucuguuuaccaucc

SEQ ID NO: 7901 - DNA, 17 bp; single-stranded, linear
ugucuguuuaccaucca

SEQ ID NO: 7902 - DNA, 17 bp; single-stranded, linear
gucuguuuaccauccaa

SEQ ID NO: 7903 - DNA, 17 bp; single-stranded, linear
uuuaccauccaaagcau

SEQ ID NO: 7904 - DNA, 17 bp; single-stranded, linear
caaagcauauuuaacau

SEQ ID NO: 7905 - DNA, 17 bp; single-stranded, linear
aagcauauuuaacaugu

SEQ ID NO: 7906 - DNA, 17 bp; single-stranded, linear
agcauauuuaacaugug

SEQ ID NO: 7907 - DNA, 17 bp; single-stranded, linear
gcauauuuaacaugugu

SEQ ID NO: 7908 - DNA, 17 bp; single-stranded, linear
acaugugucaguggggg

SEQ ID NO: 7909 - DNA, 17 bp; single-stranded, linear
guggcgcuuggcuucug

SEQ ID NO: 7910 - DNA, 17 bp; single-stranded, linear
gcuuggcuucugaggcc

SEQ ID NO: 7911 - DNA, 17 bp; single-stranded, linear
cuuggcuucugaggcca

SEQ ID NO: 7912 - DNA, 17 bp; single-stranded, linear
agagccaucaucaguuc

SEQ ID NO: 7913 - DNA, 17 bp; single-stranded, linear
gccaucaucaguuccuc

SEQ ID NO: 7914 - DNA, 17 bp; single-stranded, linear
ucaucaguuccucuagu

SEQ ID NO: 7915 - DNA, 17 bp; single-stranded, linear
caucaguuccucuagug

SEQ ID NO: 7916 - DNA, 17 bp; single-stranded, linear
caguuccucuagugaga

SEQ ID NO: 7917 - DNA, 17 bp; single-stranded, linear
guuccucuagugagaug

SEQ ID NO: 7918 - DNA, 17 bp; single-stranded, linear
agaugcauugaggucau

SEQ ID NO: 7919 - DNA, 17 bp; single-stranded, linear
auugaggucauacccaa

SEQ ID NO: 7920 - DNA, 17 bp; single-stranded, linear
gaggucauacccaagcu

SEQ ID NO: 7921 - DNA, 17 bp; single-stranded, linear
cccaagcuugcaggccu

SEQ ID NO: 7922 - DNA, 17 bp; single-stranded, linear
ccugaccuucgcauacu

SEQ ID NO: 7923 - DNA, 17 bp; single-stranded, linear
cugaccuucgcauacug

SEQ ID NO: 7924 - DNA, 17 bp; single-stranded, linear
cuucgcauacugcucac

SEQ ID NO: 7925 - DNA, 17 bp; single-stranded, linear
auacugcucacggggag

SEQ ID NO: 7926 - DNA, 17 bp; single-stranded, linear
cggggaguuaagugguc

SEQ ID NO: 7927 - DNA, 17 bp; single-stranded, linear
ggggaguuaaguggucc

SEQ ID NO: 7928 - DNA, 17 bp; single-stranded, linear
uaagugguccaguuugg

SEQ ID NO: 7929 - DNA, 17 bp; single-stranded, linear
gguccaguuuggccuag

SEQ ID NO: 7930 - DNA, 17 bp; single-stranded, linear
guccaguuuggccuagu

SEQ ID NO: 7931 - DNA, 17 bp; single-stranded, linear
uuuggccuaguaagguu

SEQ ID NO: 7932 - DNA, 17 bp; single-stranded, linear
ggccuaguaagguugcc

SEQ ID NO: 7933 - DNA, 17 bp; single-stranded, linear
aguaagguugccuacug

SEQ ID NO: 7934 - DNA, 17 bp; single-stranded, linear
gguugccuacugauggg

SEQ ID NO: 7935 - DNA, 17 bp; single-stranded, linear
gaugggcucaaaagcca

SEQ ID NO: 7936 - DNA, 17 bp; single-stranded, linear
agccacauuuuaaacag

SEQ ID NO: 7937 - DNA, 17 bp; single-stranded, linear
gccacauuuuaaacagg

SEQ ID NO: 7938 - DNA, 17 bp; single-stranded, linear
ccacauuuuaaacaggu

SEQ ID NO: 7939 - DNA, 17 bp; single-stranded, linear
cacauuuuaaacagguu

SEQ ID NO: 7940 - DNA, 17 bp; single-stranded, linear
aaacagguuuuaucuca

SEQ ID NO: 7941 - DNA, 17 bp; single-stranded, linear
aacagguuuuaucucaa

SEQ ID NO: 7942 - DNA, 17 bp; single-stranded, linear
acagguuuuaucucaag

SEQ ID NO: 7943 - DNA, 17 bp; single-stranded, linear
cagguuuuaucucaagu

SEQ ID NO: 7944 - DNA, 17 bp; single-stranded, linear
gguuuuaucucaaguau

SEQ ID NO: 7945 - DNA, 17 bp; single-stranded, linear
uuuuaucucaaguauua

SEQ ID NO: 7946 - DNA, 17 bp; single-stranded, linear
ucucaaguauuaauaua

SEQ ID NO: 7947 - DNA, 17 bp; single-stranded, linear
ucaaguauuaauauaua

SEQ ID NO: 7948 - DNA, 17 bp; single-stranded, linear
caaguauuaauauauag

SEQ ID NO: 7949 - DNA, 17 bp; single-stranded, linear
guauuaauauauagaca

SEQ ID NO: 7950 - DNA, 17 bp; single-stranded, linear
auuaauauauagacaag

SEQ ID NO: 7951 - DNA, 17 bp; single-stranded, linear
uaauauauagacaagac

SEQ ID NO: 7952 - DNA, 17 bp; single-stranded, linear
aagacacuuaugcauua

SEQ ID NO: 7953 - DNA, 17 bp; single-stranded, linear
agacacuuaugcauuau

SEQ ID NO: 7954 - DNA, 17 bp; single-stranded, linear
uuaugcauuauccuguu

SEQ ID NO: 7955 - DNA, 17 bp; single-stranded, linear
uaugcauuauccuguuu

SEQ ID NO: 7956 - DNA, 17 bp; single-stranded, linear
ugcauuauccuguuuua

SEQ ID NO: 7957 - DNA, 17 bp; single-stranded, linear
uauccuguuuuauauau

SEQ ID NO: 7958 - DNA, 17 bp; single-stranded, linear
auccuguuuuauauauc

SEQ ID NO: 7959 - DNA, 17 bp; single-stranded, linear
uccuguuuuauauaucc

SEQ ID NO: 7960 - DNA, 17 bp; single-stranded, linear
ccuguuuuauauaucca

SEQ ID NO: 7961 - DNA, 17 bp; single-stranded, linear
uguuuuauauauccaau

SEQ ID NO: 7962 - DNA, 17 bp; single-stranded, linear
uuuuauauauccaauga

SEQ ID NO: 7963 - DNA, 17 bp; single-stranded, linear
uuauauauccaaugaau

SEQ ID NO: 7964 - DNA, 17 bp; single-stranded, linear
caaugaauauaacuggg

SEQ ID NO: 7965 - DNA, 17 bp; single-stranded, linear
augaauauaacuggggc

SEQ ID NO: 7966 - DNA, 17 bp; single-stranded, linear
gggcgaguuaagaguca

SEQ ID NO: 7967 - DNA, 17 bp; single-stranded, linear
ggcgaguuaagagucau

SEQ ID NO: 7968 - DNA, 17 bp; single-stranded, linear
uuaagagucauggucua

SEQ ID NO: 7969 - DNA, 17 bp; single-stranded, linear
gucauggucuagaaaag

SEQ ID NO: 7970 - DNA, 17 bp; single-stranded, linear
cauggucuagaaaaggg

SEQ ID NO: 7971 - DNA, 17 bp; single-stranded, linear
aaagggguuucucugua

SEQ ID NO: 7972 - DNA, 17 bp; single-stranded, linear
aagggguuucucuguac

SEQ ID NO: 7973 - DNA, 17 bp; single-stranded, linear
agggguuucucuguacc

SEQ ID NO: 7974 - DNA, 17 bp; single-stranded, linear
ggguuucucuguaccca

SEQ ID NO: 7975 - DNA, 17 bp; single-stranded, linear
uucucuguacccaaauc

SEQ ID NO: 7976 - DNA, 17 bp; single-stranded, linear
acccaaaucgggcuggu

SEQ ID NO: 7977 - DNA, 17 bp; single-stranded, linear
gggcugguuggaccaag

SEQ ID NO: 7978 - DNA, 17 bp; single-stranded, linear
agagugguugucccagc

SEQ ID NO: 7979 - DNA, 17 bp; single-stranded, linear
gugguugucccagcuau

SEQ ID NO: 7980 - DNA, 17 bp; single-stranded, linear
ucccagcuauaguuacu

SEQ ID NO: 7981 - DNA, 17 bp; single-stranded, linear
ccagcuauaguuacuaa

SEQ ID NO: 7982 - DNA, 17 bp; single-stranded, linear
gcuauaguuacuaaacu

SEQ ID NO: 7983 - DNA, 17 bp; single-stranded, linear
cuauaguuacuaaacua

SEQ ID NO: 7984 - DNA, 17 bp; single-stranded, linear
uaguuacuaaacuacuc

SEQ ID NO: 7985 - DNA, 17 bp; single-stranded, linear
acuaaacuacucaccca

SEQ ID NO: 7986 - DNA, 17 bp; single-stranded, linear
aaacuacucacccaaag

SEQ ID NO: 7987 - DNA, 17 bp; single-stranded, linear
cccaaaguugggaccuc

SEQ ID NO: 7988 - DNA, 17 bp; single-stranded, linear
ugggaccucacuggcuu

SEQ ID NO: 7989 - DNA, 17 bp; single-stranded, linear
cacuggcuucucuuuac

SEQ ID NO: 7990 - DNA, 17 bp; single-stranded, linear
acuggcuucucuuuacu

SEQ ID NO: 7991 - DNA, 17 bp; single-stranded, linear
uggcuucucuuuacuuc

SEQ ID NO: 7992 - DNA, 17 bp; single-stranded, linear
gcuucucuuuacuucau

SEQ ID NO: 7993 - DNA, 17 bp; single-stranded, linear
cuucucuuuacuucauc

SEQ ID NO: 7994 - DNA, 17 bp; single-stranded, linear
uucucuuuacuucauca

SEQ ID NO: 7995 - DNA, 17 bp; single-stranded, linear
ucuuuacuucaucaugg

SEQ ID NO: 7996 - DNA, 17 bp; single-stranded, linear
cuuuacuucaucaugga

SEQ ID NO: 7997 - DNA, 17 bp; single-stranded, linear
uacuucaucauggauuu

SEQ ID NO: 7998 - DNA, 17 bp; single-stranded, linear
ucauggauuucaccauc

SEQ ID NO: 7999 - DNA, 17 bp; single-stranded, linear
cauggauuucaccaucc

SEQ ID NO: 8000 - DNA, 17 bp; single-stranded, linear
auggauuucaccauccc

SEQ ID NO: 8001 - DNA, 17 bp; single-stranded, linear
uucaccaucccaaggca

SEQ ID NO: 8002 - DNA, 17 bp; single-stranded, linear
aaggcagucugagagga

SEQ ID NO: 8003 - DNA, 17 bp; single-stranded, linear
gaggagcuaaagaguau

SEQ ID NO: 8004 - DNA, 17 bp; single-stranded, linear
uaaagaguaucagccca

SEQ ID NO: 8005 - DNA, 17 bp; single-stranded, linear
aagaguaucagcccaua

SEQ ID NO: 8006 - DNA, 17 bp; single-stranded, linear
cagcccauauuuauuaa

SEQ ID NO: 8007 - DNA, 17 bp; single-stranded, linear
gcccauauuuauuaagc

SEQ ID NO: 8008 - DNA, 17 bp; single-stranded, linear
cccauauuuauuaagca

SEQ ID NO: 8009 - DNA, 17 bp; single-stranded, linear
ccauauuuauuaagcac

SEQ ID NO: 8010 - DNA, 17 bp; single-stranded, linear
auauuuauuaagcacuu

SEQ ID NO: 8011 - DNA, 17 bp; single-stranded, linear
uauuuauuaagcacuuu

SEQ ID NO: 8012 - DNA, 17 bp; single-stranded, linear
uaagcacuuuaugcucc

SEQ ID NO: 8013 - DNA, 17 bp; single-stranded, linear
aagcacuuuaugcuccu

SEQ ID NO: 8014 - DNA, 17 bp; single-stranded, linear
agcacuuuaugcuccuu

SEQ ID NO: 8015 - DNA, 17 bp; single-stranded, linear
uuuaugcuccuuggcac

SEQ ID NO: 8016 - DNA, 17 bp; single-stranded, linear
augcuccuuggcacagc

SEQ ID NO: 8017 - DNA, 17 bp; single-stranded, linear
ugauguguaauuuaugc

SEQ ID NO: 8018 - DNA, 17 bp; single-stranded, linear
uguguaauuuaugcaag

SEQ ID NO: 8019 - DNA, 17 bp; single-stranded, linear
guguaauuuaugcaagc

SEQ ID NO: 8020 - DNA, 17 bp; single-stranded, linear
uguaauuuaugcaagcu

SEQ ID NO: 8021 - DNA, 17 bp; single-stranded, linear
ugcaagcucccucucca

SEQ ID NO: 8022 - DNA, 17 bp; single-stranded, linear
agcucccucuccagcua

SEQ ID NO: 8023 - DNA, 17 bp; single-stranded, linear
cucccucuccagcuagg

SEQ ID NO: 8024 - DNA, 17 bp; single-stranded, linear
cuccagcuaggacucag

SEQ ID NO: 8025 - DNA, 17 bp; single-stranded, linear
cuaggacucaggauauu

SEQ ID NO: 8026 - DNA, 17 bp; single-stranded, linear
cucaggauauuagucaa

SEQ ID NO: 8027 - DNA, 17 bp; single-stranded, linear
caggauauuagucaaug

SEQ ID NO: 8028 - DNA, 17 bp; single-stranded, linear
aggauauuagucaauga

SEQ ID NO: 8029 - DNA, 17 bp; single-stranded, linear
auauuagucaaugagcc

SEQ ID NO: 8030 - DNA, 17 bp; single-stranded, linear
ugagccaucaaaaggaa

SEQ ID NO: 8031 - DNA, 17 bp; single-stranded, linear
aaaaaccuaucuuauuu

SEQ ID NO: 8032 - DNA, 17 bp; single-stranded, linear
aaaccuaucuuauuuuc

SEQ ID NO: 8033 - DNA, 17 bp; single-stranded, linear
accuaucuuauuuucau

SEQ ID NO: 8034 - DNA, 17 bp; single-stranded, linear
ccuaucuuauuuucauc

SEQ ID NO: 8035 - DNA, 17 bp; single-stranded, linear
uaucuuauuuucaucug

SEQ ID NO: 8036 - DNA, 17 bp; single-stranded, linear
aucuuauuuucaucugu

SEQ ID NO: 8037 - DNA, 17 bp; single-stranded, linear
ucuuauuuucaucuguu

SEQ ID NO: 8038 - DNA, 17 bp; single-stranded, linear
cuuauuuucaucuguuu

SEQ ID NO: 8039 - DNA, 17 bp; single-stranded, linear
auuuucaucuguuucau

SEQ ID NO: 8040 - DNA, 17 bp; single-stranded, linear
ucaucuguuucauaccu

SEQ ID NO: 8041 - DNA, 17 bp; single-stranded, linear
caucuguuucauaccuu

SEQ ID NO: 8042 - DNA, 17 bp; single-stranded, linear
aucuguuucauaccuug

SEQ ID NO: 8043 - DNA, 17 bp; single-stranded, linear
uguuucauaccuugucu

SEQ ID NO: 8044 - DNA, 17 bp; single-stranded, linear
ucauaccuugucugggg

SEQ ID NO: 8045 - DNA, 17 bp; single-stranded, linear
uaccuugucuggggucu

SEQ ID NO: 8046 - DNA, 17 bp; single-stranded, linear
ucuggggucuaaugacg

SEQ ID NO: 8047 - DNA, 17 bp; single-stranded, linear
uggggucuaaugacgau

SEQ ID NO: 8048 - DNA, 17 bp; single-stranded, linear
aacaggguagacauggg

SEQ ID NO: 8049 - DNA, 17 bp; single-stranded, linear
gacaggguagaaaaggg

SEQ ID NO: 8050 - DNA, 17 bp; single-stranded, linear
ugcccgcucuuuggggu

SEQ ID NO: 8051 - DNA, 17 bp; single-stranded, linear
cccgcucuuuggggucu

SEQ ID NO: 8052 - DNA, 17 bp; single-stranded, linear
ccgcucuuuggggucua

SEQ ID NO: 8053 - DNA, 17 bp; single-stranded, linear
uuuggggucuagagaug

SEQ ID NO: 8054 - DNA, 17 bp; single-stranded, linear
uggggucuagagaugag

SEQ ID NO: 8055 - DNA, 17 bp; single-stranded, linear
cccugggucucuaaaau

SEQ ID NO: 8056 - DNA, 17 bp; single-stranded, linear
cugggucucuaaaaugg

SEQ ID NO: 8057 - DNA, 17 bp; single-stranded, linear
gggucucuaaaauggcu

SEQ ID NO: 8058 - DNA, 17 bp; single-stranded, linear
aaauggcucucuuagaa

SEQ ID NO: 8059 - DNA, 17 bp; single-stranded, linear
auggcucucuuagaagu

SEQ ID NO: 8060 - DNA, 17 bp; single-stranded, linear
ggcucucuuagaaguug

SEQ ID NO: 8061 - DNA, 17 bp; single-stranded, linear
gcucucuuagaaguugu

SEQ ID NO: 8062 - DNA, 17 bp; single-stranded, linear
uuagaaguuguaugugc

SEQ ID NO: 8063 - DNA, 17 bp; single-stranded, linear
gaaguuguaugugcaaa

SEQ ID NO: 8064 - DNA, 17 bp; single-stranded, linear
gugcaaauuauggucug

SEQ ID NO: 8065 - DNA, 17 bp; single-stranded, linear
ugcaaauuauggucugu

SEQ ID NO: 8066 - DNA, 17 bp; single-stranded, linear
auuauggucugugugcu

SEQ ID NO: 8067 - DNA, 17 bp; single-stranded, linear
ugugugcuuaggucgug

SEQ ID NO: 8068 - DNA, 17 bp; single-stranded, linear
gugugcuuaggucgugc

SEQ ID NO: 8069 - DNA, 17 bp; single-stranded, linear
gcuuaggucgugcacac

SEQ ID NO: 8070 - DNA, 17 bp; single-stranded, linear
gagccggucacagcugg

SEQ ID NO: 8071 - DNA, 17 bp; single-stranded, linear
cgaugaauagcugcuuu

SEQ ID NO: 8072 - DNA, 17 bp; single-stranded, linear
uagcugcuuugggagag

SEQ ID NO: 8073 - DNA, 17 bp; single-stranded, linear
agcugcuuugggagagc

SEQ ID NO: 8074 - DNA, 17 bp; single-stranded, linear
agcaugcuagccacuua

SEQ ID NO: 8075 - DNA, 17 bp; single-stranded, linear
uagccacuuaauucucu

SEQ ID NO: 8076 - DNA, 17 bp; single-stranded, linear
agccacuuaauucucug

SEQ ID NO: 8077 - DNA, 17 bp; single-stranded, linear
cacuuaauucucugacc

SEQ ID NO: 8078 - DNA, 17 bp; single-stranded, linear
acuuaauucucugaccg

SEQ ID NO: 8079 - DNA, 17 bp; single-stranded, linear
uuaauucucugaccggg

SEQ ID NO: 8080 - DNA, 17 bp; single-stranded, linear
gccagcaucauggguac

SEQ ID NO: 8081 - DNA, 17 bp; single-stranded, linear
ucauggguaccugcucc

SEQ ID NO: 8082 - DNA, 17 bp; single-stranded, linear
uaccugcuccccugugu

SEQ ID NO: 8083 - DNA, 17 bp; single-stranded, linear
cccuguguaccccaucc

SEQ ID NO: 8084 - DNA, 17 bp; single-stranded, linear
uaccccauccuuaaggu

SEQ ID NO: 8085 - DNA, 17 bp; single-stranded, linear
cccauccuuaagguuuu

SEQ ID NO: 8086 - DNA, 17 bp; single-stranded, linear
ccauccuuaagguuuuc

SEQ ID NO: 8087 - DNA, 17 bp; single-stranded, linear
cuuaagguuuucugucu

SEQ ID NO: 8088 - DNA, 17 bp; single-stranded, linear
uuaagguuuucugucug

SEQ ID NO: 8089 - DNA, 17 bp; single-stranded, linear
uaagguuuucugucuga

SEQ ID NO: 8090 - DNA, 17 bp; single-stranded, linear
aagguuuucugucugau

SEQ ID NO: 8091 - DNA, 17 bp; single-stranded, linear
uuuucugucugaugaga

SEQ ID NO: 8092 - DNA, 17 bp; single-stranded, linear
agugcaauccccacuga

SEQ ID NO: 8093 - DNA, 17 bp; single-stranded, linear
cuguggcucuuggugca

SEQ ID NO: 8094 - DNA, 17 bp; single-stranded, linear
guggcucuuggugcacu

SEQ ID NO: 8095 - DNA, 17 bp; single-stranded, linear
ggugcacucaccagcca

SEQ ID NO: 8096 - DNA, 17 bp; single-stranded, linear
ccaggacuagacaagua

SEQ ID NO: 8097 - DNA, 17 bp; single-stranded, linear
agacaaguaggaaaggg

SEQ ID NO: 8098 - DNA, 17 bp; single-stranded, linear
aaagggcuucuagccac

SEQ ID NO: 8099 - DNA, 17 bp; single-stranded, linear
aagggcuucuagccaca

SEQ ID NO: 8100 - DNA, 17 bp; single-stranded, linear
gggcuucuagccacacu

SEQ ID NO: 8101 - DNA, 17 bp; single-stranded, linear
aagaaaaucagguaggg

SEQ ID NO: 8102 - DNA, 17 bp; single-stranded, linear
aaucagguagggcuggc

SEQ ID NO: 8103 - DNA, 17 bp; single-stranded, linear
aaagacaucuuugucca

SEQ ID NO: 8104 - DNA, 17 bp; single-stranded, linear
agacaucuuuguccauu

SEQ ID NO: 8105 - DNA, 17 bp; single-stranded, linear
gacaucuuuguccauuc

SEQ ID NO: 8106 - DNA, 17 bp; single-stranded, linear
aucuuuguccauucgca

SEQ ID NO: 8107 - DNA, 17 bp; single-stranded, linear
uuguccauucgcaaaag

SEQ ID NO: 8108 - DNA, 17 bp; single-stranded, linear
uguccauucgcaaaagc

SEQ ID NO: 8109 - DNA, 17 bp; single-stranded, linear
caaaagcucuugucggc

SEQ ID NO: 8110 - DNA, 17 bp; single-stranded, linear
aaagcucuugucggcug

SEQ ID NO: 8111 - DNA, 17 bp; single-stranded, linear
gcucuugucggcugcag

SEQ ID NO: 8112 - DNA, 17 bp; single-stranded, linear
caguguguaagucaggc

SEQ ID NO: 8113 - DNA, 17 bp; single-stranded, linear
guguaagucaggcgaug

SEQ ID NO: 8114 - DNA, 17 bp; single-stranded, linear
cagaggcuaccagagaa

SEQ ID NO: 8115 - DNA, 17 bp; single-stranded, linear
ccugagguuucucaucc

SEQ ID NO: 8116 - DNA, 17 bp; single-stranded, linear
cugagguuucucaucca

SEQ ID NO: 8117 - DNA, 17 bp; single-stranded, linear
ugagguuucucauccag

SEQ ID NO: 8118 - DNA, 17 bp; single-stranded, linear
agguuucucauccagau

SEQ ID NO: 8119 - DNA, 17 bp; single-stranded, linear
uuucucauccagauauc

SEQ ID NO: 8120 - DNA, 17 bp; single-stranded, linear
auccagauauccagcaa

SEQ ID NO: 8121 - DNA, 17 bp; single-stranded, linear
ccagauauccagcaauu

SEQ ID NO: 8122 - DNA, 17 bp; single-stranded, linear
ccagcaauuggggggug

SEQ ID NO: 8123 - DNA, 17 bp; single-stranded, linear
aagaccauagauggucc

SEQ ID NO: 8124 - DNA, 17 bp; single-stranded, linear
uagaugguccuguauua

SEQ ID NO: 8125 - DNA, 17 bp; single-stranded, linear
gguccuguauuauuccg

SEQ ID NO: 8126 - DNA, 17 bp; single-stranded, linear
uccuguauuauuccgau

SEQ ID NO: 8127 - DNA, 17 bp; single-stranded, linear
ccuguauuauuccgauu

SEQ ID NO: 8128 - DNA, 17 bp; single-stranded, linear
uguauuauuccgauuuu

SEQ ID NO: 8129 - DNA, 17 bp; single-stranded, linear
guauuauuccgauuuua

SEQ ID NO: 8130 - DNA, 17 bp; single-stranded, linear
auuccgauuuuaauaau

SEQ ID NO: 8131 - DNA, 17 bp; single-stranded, linear
uuccgauuuuaauaauc

SEQ ID NO: 8132 - DNA, 17 bp; single-stranded, linear
uccgauuuuaauaaucu

SEQ ID NO: 8133 - DNA, 17 bp; single-stranded, linear
ccgauuuuaauaaucua

SEQ ID NO: 8134 - DNA, 17 bp; single-stranded, linear
auuuuaauaaucuaauu

SEQ ID NO: 8135 - DNA, 17 bp; single-stranded, linear
uuaauaaucuaauucgu

SEQ ID NO: 8136 - DNA, 17 bp; single-stranded, linear
aauaaucuaauucguga

SEQ ID NO: 8137 - DNA, 17 bp; single-stranded, linear
aaucuaauucgugauca

SEQ ID NO: 8138 - DNA, 17 bp; single-stranded, linear
aucuaauucgugaucau

SEQ ID NO: 8139 - DNA, 17 bp; single-stranded, linear
uucgugaucauuaagag

SEQ ID NO: 8140 - DNA, 17 bp; single-stranded, linear
gugaucauuaagagacu

SEQ ID NO: 8141 - DNA, 17 bp; single-stranded, linear
ugaucauuaagagacuu

SEQ ID NO: 8142 - DNA, 17 bp; single-stranded, linear
aagagacuuuaguaaau

SEQ ID NO: 8143 - DNA, 17 bp; single-stranded, linear
agagacuuuaguaaaug

SEQ ID NO: 8144 - DNA, 17 bp; single-stranded, linear
gagacuuuaguaaaugu

SEQ ID NO: 8145 - DNA, 17 bp; single-stranded, linear
acuuuaguaaauguccc

SEQ ID NO: 8146 - DNA, 17 bp; single-stranded, linear
guaaaugucccuuuucc

SEQ ID NO: 8147 - DNA, 17 bp; single-stranded, linear
augucccuuuucccaca

SEQ ID NO: 8148 - DNA, 17 bp; single-stranded, linear
ugucccuuuucccacaa

SEQ ID NO: 8149 - DNA, 17 bp; single-stranded, linear
gucccuuuucccacaaa

SEQ ID NO: 8150 - DNA, 17 bp; single-stranded, linear
ucccuuuucccacaaaa

SEQ ID NO: 8151 - DNA, 17 bp; single-stranded, linear
acaaaaguaaagaaaag

SEQ ID NO: 8152 - DNA, 17 bp; single-stranded, linear
gaaaagcuaucgggauu

SEQ ID NO: 8153 - DNA, 17 bp; single-stranded, linear
aaagcuaucgggauucu

SEQ ID NO: 8154 - DNA, 17 bp; single-stranded, linear
aucgggauucucugguu

SEQ ID NO: 8155 - DNA, 17 bp; single-stranded, linear
ucgggauucucugguuc

SEQ ID NO: 8156 - DNA, 17 bp; single-stranded, linear
gggauucucugguucug

SEQ ID NO: 8157 - DNA, 17 bp; single-stranded, linear
ucucugguucugcuuaa

SEQ ID NO: 8158 - DNA, 17 bp; single-stranded, linear
cucugguucugcuuaaa

SEQ ID NO: 8159 - DNA, 17 bp; single-stranded, linear
guucugcuuaaagacuu

SEQ ID NO: 8160 - DNA, 17 bp; single-stranded, linear
uucugcuuaaagacuua

SEQ ID NO: 8161 - DNA, 17 bp; single-stranded, linear
uaaagacuuagcuuugg

SEQ ID NO: 8162 - DNA, 17 bp; single-stranded, linear
aaagacuuagcuuugga

SEQ ID NO: 8163 - DNA, 17 bp; single-stranded, linear
acuuagcuuuggagccu

SEQ ID NO: 8164 - DNA, 17 bp; single-stranded, linear
cuuagcuuuggagccua

SEQ ID NO: 8165 - DNA, 17 bp; single-stranded, linear
uggagccuaugaaaguu

SEQ ID NO: 8166 - DNA, 17 bp; single-stranded, linear
augaaaguugaucagcc

SEQ ID NO: 8167 - DNA, 54 bp; single-stranded, linear
gucccagcagaagaccauaccagagaaacacacguugugguacauuaccuggua

SEQ ID NO: 8168 - DNA, 54 bp; single-stranded, linear
ggugucccagaagcugacaccagagaaacacacguugugguacauuaccuggua

SEQ ID NO: 8169 - DNA, 54 bp; single-stranded, linear
uaaggcaaagaagcggugaccagagaaacacacguugugguacauuaccuggua

SEQ ID NO: 8170 - DNA, 54 bp; single-stranded, linear
gacacccgagaagcgcguaccagagaaacacacguugugguacauuaccuggua

SEQ ID NO: 8171 - DNA, 54 bp; single-stranded, linear
cugugagaagaagacaccaccagagaaacacacguugugguacauuaccuggua

SEQ ID NO: 8172 - DNA, 54 bp; single-stranded, linear
gaaagagaagaaggccugaccagagaaacacacguugugguacauuaccuggua

SEQ ID NO: 8173 - DNA, 54 bp; single-stranded, linear
caugagugagaagccuccaccagagaaacacacguugugguacauuaccuggua

SEQ ID NO: 8174 - DNA, 54 bp; single-stranded, linear
cggucgugagaagagaccaccagagaaacacacguugugguacauuaccuggua

SEQ ID NO: 8175 - DNA, 54 bp; single-stranded, linear
cucccacaagaagaugggaccagagaaacacacguugugguacauuaccuggua

SEQ ID NO: 8176 - DNA, 54 bp; single-stranded, linear
ggaugaugagaagucuucaccagagaaacacacguugugguacauuaccuggua

SEQ ID NO: 8177 - DNA, 54 bp; single-stranded, linear
cgucacccagaaggggauaccagagaaacacacguugugguacauuaccuggua

SEQ ID NO: 8178 - DNA, 54 bp; single-stranded, linear
cuuugcccagaagggguaaccagagaaacacacguugugguacauuaccuggua

SEQ ID NO: 8179 - DNA, 54 bp; single-stranded, linear
cgcaguucagaaguccuaaccagagaaacacacguugugguacauuaccuggua

SEQ ID NO: 8180 - DNA, 54 bp; single-stranded, linear
gccgauggagaagauaguaccagagaaacacacguugugguacauuaccuggua

SEQ ID NO: 8181 - DNA, 54 bp; single-stranded, linear
uuguauugagaagccgauaccagagaaacacacguugugguacauuaccuggua

SEQ ID NO: 8182 - DNA, 54 bp; single-stranded, linear
cugggcucagaaggcguaaccagagaaacacacguugugguacauuaccuggua

SEQ ID NO: 8183 - DNA, 54 bp; single-stranded, linear
gcccguggagaagucucaaccagagaaacacacguugugguacauuaccuggua

SEQ ID NO: 8184 - DNA, 54 bp; single-stranded, linear
ggacaagaagaagcccguaccagagaaacacacguugugguacauuaccuggua

SEQ ID NO: 8185 - DNA, 54 bp; single-stranded, linear
uccggucaagaagcugccaccagagaaacacacguugugguacauuaccuggua

SEQ ID NO: 8186 - DNA, 54 bp; single-stranded, linear
cuucacgcagaagguguaaccagagaaacacacguugugguacauuaccuggua

SEQ ID NO: 8187 - DNA, 54 bp; single-stranded, linear
uguugaaaagaaggaacgaccagagaaacacacguugugguacauuaccuggua

SEQ ID NO: 8188 - DNA, 54 bp; single-stranded, linear
ccugcaccagaagcuuccaccagagaaacacacguugugguacauuaccuggua

SEQ ID NO: 8189 - DNA, 54 bp; single-stranded, linear
gccgauagagaagucuucaccagagaaacacacguugugguacauuaccuggua

SEQ ID NO: 8190 - DNA, 54 bp; single-stranded, linear
ucauggacagaagauaggaccagagaaacacacguugugguacauuaccuggua

SEQ ID NO: 8191 - DNA, 54 bp; single-stranded, linear
cuuucaugagaagccgauaccagagaaacacacguugugguacauuaccuggua

SEQ ID NO: 8192 - DNA, 54 bp; single-stranded, linear
aaauagcgagaagacuucaccagagaaacacacguugugguacauuaccuggua

SEQ ID NO: 8193 - DNA, 54 bp; single-stranded, linear
uuucguagagaagagguuaccagagaaacacacguugugguacauuaccuggua

SEQ ID NO: 8194 - DNA, 54 bp; single-stranded, linear
ugcugcccagaagauagaaccagagaaacacacguugugguacauuaccuggua

SEQ ID NO: 8195 - DNA, 54 bp; single-stranded, linear
gucugagaagaagccaccaccagagaaacacacguugugguacauuaccuggua

SEQ ID NO: 8196 - DNA, 54 bp; single-stranded, linear
uuccagggagaagagaguaccagagaaacacacguugugguacauuaccuggua

SEQ ID NO: 8197 - DNA, 54 bp; single-stranded, linear
ggcccggcagaaguagauaccagagaaacacacguugugguacauuaccuggua

SEQ ID NO: 8198 - DNA, 54 bp; single-stranded, linear
gaaggcccagaagcuguaaccagagaaacacacguugugguacauuaccuggua

SEQ ID NO: 8199 - DNA, 54 bp; single-stranded, linear
uucggcacagaagugacaaccagagaaacacacguugugguacauuaccuggua

SEQ ID NO: 8200 - DNA, 54 bp; single-stranded, linear
ucuccuucagaaggcaucaccagagaaacacacguugugguacauuaccuggua

SEQ ID NO: 8201 - DNA, 54 bp; single-stranded, linear
ccacacagagaaguuucaaccagagaaacacacguugugguacauuaccuggua

SEQ ID NO: 8202 - DNA, 54 bp; single-stranded, linear
gguuuugaagaaggugugaccagagaaacacacguugugguacauuaccuggua

SEQ ID NO: 8203 - DNA, 54 bp; single-stranded, linear
accaagugagaagaggcgaccagagaaacacacguugugguacauuaccuggua

SEQ ID NO: 8204 - DNA, 54 bp; single-stranded, linear; identical to SEQ ID NO: 2917

SEQ ID NO: 8205 - DNA, 54 bp; single-stranded, linear
gugagguaagaagcgcuuaccagagaaacacacguugugguacauuaccuggua

SEQ ID NO: 8206 - DNA, 54 bp; single-stranded, linear
ugagcgugagaagcuccaaccagagaaacacacguugugguacauuaccuggua

SEQ ID NO: 8207 - DNA, 54 bp; single-stranded, linear
cggaagaaagaagcuucaaccagagaaacacacguugugguacauuaccuggua

SEQ ID NO: 8208 - DNA, 54 bp; single-stranded, linear
gacagguaagaagucuuuaccagagaaacacacguugugguacauuaccuggua

SEQ ID NO: 8209 - DNA, 54 bp; single-stranded, linear; identical to SEQ ID NO: 2921

SEQ ID NO: 8210 - DNA, 54 bp; single-stranded, linear
cauagggcagaaguucacaccagagaaacacacguugugguacauuaccuggua

SEQ ID NO: 8211 - DNA, 54 bp; single-stranded, linear
caucauagagaagccguuaccagagaaacacacguugugguacauuaccuggua

SEQ ID NO: 8212 - DNA, 54 bp; single-stranded, linear
cacaguccagaaggugggaccagagaaacacacguugugguacauuaccuggua

SEQ ID NO: 8213 - DNA, 54 bp; single-stranded, linear
cagccacaagaaggcaggaccagagaaacacacguugugguacauuaccuggua

SEQ ID NO: 8214 - DNA, 54 bp; single-stranded, linear
guucggucagaagagcuuaccagagaaacacacguugugguacauuaccuggua

SEQ ID NO: 8215 - DNA, 54 bp; single-stranded, linear
cgaucaccagaagaggccaccagagaaacacacguugugguacauuaccuggua

SEQ ID NO: 8216 - DNA, 54 bp; single-stranded, linear
gguaguugagaagguuucaccagagaaacacacguugugguacauuaccuggua

SEQ ID NO: 8217 - DNA, 54 bp; single-stranded, linear
cuuguugaagaagaauaaaccagagaaacacacguugugguacauuaccuggua

SEQ ID NO: 8218 - DNA, 54 bp; single-stranded, linear
auaugcaaagaagcguccaccagagaaacacacguugugguacauuaccuggua

SEQ ID NO: 8219 - DNA, 54 bp; single-stranded, linear
acugucuaagaagggcuuaccagagaaacacacguugugguacauuaccuggua

SEQ ID NO: 8220 - DNA, 54 bp; single-stranded, linear
gacacuugagaagcugacaccagagaaacacacguugugguacauuaccuggua

SEQ ID NO: 8221 - DNA, 54 bp; single-stranded, linear
gaagcuggagaaggugacaccagagaaacacacguugugguacauuaccuggua

SEQ ID NO: 8222 - DNA, 54 bp; single-stranded, linear
uucagggaagaaggagcuaccagagaaacacacguugugguacauuaccuggua

SEQ ID NO: 8223 - DNA, 54 bp; single-stranded, linear
uggugaggagaagcuuggaccagagaaacacacguugugguacauuaccuggua

SEQ ID NO: 8224 - DNA, 54 bp; single-stranded, linear
uguaggaaagaaggucuuaccagagaaacacacguugugguacauuaccuggua

SEQ ID NO: 8225 - DNA, 54 bp; single-stranded, linear
cacuuggaagaaguaggaaccagagaaacacacguugugguacauuaccuggua

SEQ ID NO: 8226 - DNA, 54 bp; single-stranded, linear
uucuggagagaagaaacuaccagagaaacacacguugugguacauuaccuggua

SEQ ID NO: 8227 - DNA, 54 bp; single-stranded, linear; identical to SEQ ID NO: 2933

SEQ ID NO: 8228 - DNA, 54 bp; single-stranded, linear
cuucaggcagaagcagaaaccagagaaacacacguugugguacauuaccuggua

SEQ ID NO: 8229 - DNA, 54 bp; single-stranded, linear
uuccuucaagaagcugcaaccagagaaacacacguugugguacauuaccuggua

SEQ ID NO: 8230 - DNA, 54 bp; single-stranded, linear
ggguucucagaagcaugcaccagagaaacacacguugugguacauuaccuggua

SEQ ID NO: 8231 - DNA, 54 bp; single-stranded, linear
guucagcaagaaggggccaccagagaaacacacguugugguacauuaccuggua

SEQ ID NO: 8232 - DNA, 54 bp; single-stranded, linear
uggcuugaagaaggucacaccagagaaacacacguugugguacauuaccuggua

SEQ ID NO: 8233 - DNA, 54 bp; single-stranded, linear
uguuucuaagaaguauggaccagagaaacacacguugugguacauuaccuggua

SEQ ID NO: 8234 - DNA, 54 bp; single-stranded, linear
aucugcaaagaaguccuuaccagagaaacacacguugugguacauuaccuggua

SEQ ID NO: 8235 - DNA, 54 bp; single-stranded, linear
aaauguggagaagcaaagaccagagaaacacacguugugguacauuaccuggua

SEQ ID NO: 8236 - DNA, 54 bp; single-stranded, linear
cucacaucagaagagcuuaccagagaaacacacguugugguacauuaccuggua

SEQ ID NO: 8237 - DNA, 54 bp; single-stranded, linear
uaguguccagaagauaguaccagagaaacacacguugugguacauuaccuggua

SEQ ID NO: 8238 - DNA, 54 bp; single-stranded, linear
gggagcccagaagagugcaccagagaaacacacguugugguacauuaccuggua

SEQ ID NO: 8239 - DNA, 54 bp; single-stranded, linear
uccaggugagaagcuucaaccagagaaacacacguugugguacauuaccuggua

SEQ ID NO: 8240 - DNA, 54 bp; single-stranded, linear
cucggcagagaagaaaguaccagagaaacacacguugugguacauuaccuggua

SEQ ID NO: 8241 - DNA, 54 bp; single-stranded, linear
ugggccucagaagaucggaccagagaaacacacguugugguacauuaccuggua

SEQ ID NO: 8242 - DNA, 54 bp; single-stranded, linear
gaagcagaagaagggccuaccagagaaacacacguugugguacauuaccuggua

SEQ ID NO: 8243 - DNA, 54 bp; single-stranded, linear
gcuggagaagaagaagcuaccagagaaacacacguugugguacauuaccuggua

SEQ ID NO: 8244 - DNA, 54 bp; single-stranded, linear
guggccacagaaggagaaaccagagaaacacacguugugguacauuaccuggua

SEQ ID NO: 8245 - DNA, 54 bp; single-stranded, linear
uggagaacagaaggacucaccagagaaacacacguugugguacauuaccuggua

SEQ ID NO: 8246 - DNA, 54 bp; single-stranded, linear
ggguggagagaagcaggaaccagagaaacacacguugugguacauuaccuggua

SEQ ID NO: 8247 - DNA, 54 bp; single-stranded, linear
gaguuguaagaaggggguaccagagaaacacacguugugguacauuaccuggua

SEQ ID NO: 8248 - DNA, 54 bp; single-stranded, linear
uuuaggcgagaagggaggaccagagaaacacacguugugguacauuaccuggua

SEQ ID NO: 8249 - DNA, 54 bp; single-stranded, linear
aagcuuuaagaaggcgggaccagagaaacacacguugugguacauuaccuggua

SEQ ID NO: 8250 - DNA, 54 bp; single-stranded, linear
guugucggagaaggugagaccagagaaacacacguugugguacauuaccuggua

SEQ ID NO: 8251 - DNA, 54 bp; single-stranded, linear
cugucaggagaagguuguaccagagaaacacacguugugguacauuaccuggua

SEQ ID NO: 8252 - DNA, 54 bp; single-stranded, linear
uccuguggagaagaauagaccagagaaacacacguugugguacauuaccuggua

SEQ ID NO: 8253 - DNA, 54 bp; single-stranded, linear
cgaaaagcagaaggcuccaccagagaaacacacguugugguacauuaccuggua

SEQ ID NO: 8254 - DNA, 54 bp; single-stranded, linear
ucacgaaaagaagcuggcaccagagaaacacacguugugguacauuaccuggua

SEQ ID NO: 8255 - DNA, 54 bp; single-stranded, linear
uuagucaaagaagcaacaaccagagaaacacacguugugguacauuaccuggua

SEQ ID NO: 8256 - DNA, 54 bp; single-stranded, linear
ggugggcgagaagucgccaccagagaaacacacguugugguacauuaccuggua

SEQ ID NO: 8257 - DNA, 54 bp; single-stranded, linear
ggccggugagaaggcgguaccagagaaacacacguugugguacauuaccuggua

SEQ ID NO: 8258 - DNA, 54 bp; single-stranded, linear
agucccacagaagcagggaccagagaaacacacguugugguacauuaccuggua

SEQ ID NO: 8259 - DNA, 54 bp; single-stranded, linear
cagagcagagaagugcauaccagagaaacacacguugugguacauuaccuggua

SEQ ID NO: 8260 - DNA, 54 bp; single-stranded, linear
agagacagagaaggucagaccagagaaacacacguugugguacauuaccuggua

SEQ ID NO: 8261 - DNA, 54 bp; single-stranded, linear
auaagagaagaagagcagaccagagaaacacacguugugguacauuaccuggua

SEQ ID NO: 8262 - DNA, 54 bp; single-stranded, linear
cuccacagagaagacgcaaccagagaaacacacguugugguacauuaccuggua

SEQ ID NO: 8263 - DNA, 54 bp; single-stranded, linear
cccgaaacagaagaggccaccagagaaacacacguugugguacauuaccuggua

SEQ ID NO: 8264 - DNA, 54 bp; single-stranded, linear
gggcccgaagaagcggagaccagagaaacacacguugugguacauuaccuggua

SEQ ID NO: 8265 - DNA, 54 bp; single-stranded, linear
aaacagacagaagaagacaccagagaaacacacguugugguacauuaccuggua

SEQ ID NO: 8266 - DNA, 54 bp; single-stranded, linear
ggaugguaagaagacaacaccagagaaacacacguugugguacauuaccuggua

SEQ ID NO: 8267 - DNA, 54 bp; single-stranded, linear
acuagaggagaagaugauaccagagaaacacacguugugguacauuaccuggua

SEQ ID NO: 8268 - DNA, 54 bp; single-stranded, linear
augcgaagagaaggccugaccagagaaacacacguugugguacauuaccuggua

SEQ ID NO: 8269 - DNA, 54 bp; single-stranded, linear
uccccgugagaaguaugcaccagagaaacacacguugugguacauuaccuggua

SEQ ID NO: 8270 - DNA, 54 bp; single-stranded, linear
cuaggccaagaaggaccaaccagagaaacacacguugugguacauuaccuggua

SEQ ID NO: 8271 - DNA, 54 bp; single-stranded, linear
uugagcccagaaguaggcaccagagaaacacacguugugguacauuaccuggua

SEQ ID NO: 8272 - DNA, 54 bp; single-stranded, linear
auauauaaagaaggauaaaccagagaaacacacguugugguacauuaccuggua

SEQ ID NO: 8273 - DNA, 54 bp; single-stranded, linear
uccucucaagaagccuugaccagagaaacacacguugugguacauuaccuggua

SEQ ID NO: 8274 - DNA, 54 bp; single-stranded, linear
uaaauaugagaagauacuaccagagaaacacacguugugguacauuaccuggua

SEQ ID NO: 8275 - DNA, 54 bp; single-stranded, linear
agguaugaagaagaugaaaccagagaaacacacguugugguacauuaccuggua

SEQ ID NO: 8276 - DNA, 54 bp; single-stranded, linear
ccccaaagagaaggcaccaccagagaaacacacguugugguacauuaccuggua

SEQ ID NO: 8277 - DNA, 54 bp; single-stranded, linear
ccggcuccagaaggugugaccagagaaacacacguugugguacauuaccuggua

SEQ ID NO: 8278 - DNA, 54 bp; single-stranded, linear
gucugcccagaagugaccaccagagaaacacacguugugguacauuaccuggua

SEQ ID NO: 8279 - DNA, 54 bp; single-stranded, linear
uauucaucagaagcccagaccagagaaacacacguugugguacauuaccuggua

SEQ ID NO: 8280 - DNA, 54 bp; single-stranded, linear
ucucccaaagaagcuauuaccagagaaacacacguugugguacauuaccuggua

SEQ ID NO: 8281 - DNA, 54 bp; single-stranded, linear
cuggcccgagaagagaauaccagagaaacacacguugugguacauuaccuggua

SEQ ID NO: 8282 - DNA, 54 bp; single-stranded, linear
cacaggggagaagguaccaccagagaaacacacguugugguacauuaccuggua

SEQ ID NO: 8283 - DNA, 54 bp; single-stranded, linear
ucucaucaagaagaaaacaccagagaaacacacguugugguacauuaccuggua

SEQ ID NO: 8284 - DNA, 54 bp; single-stranded, linear
ccagucucagaagacagaaccagagaaacacacguugugguacauuaccuggua

SEQ ID NO: 8285 - DNA, 54 bp; single-stranded, linear
gggcugcaagaagucucaaccagagaaacacacguugugguacauuaccuggua

SEQ ID NO: 8286 - DNA, 54 bp; single-stranded, linear
ccacagugagaagcaggcaccagagaaacacacguugugguacauuaccuggua

SEQ ID NO: 8287 - DNA, 54 bp; single-stranded, linear
cacacugcagaagacaagaccagagaaacacacguugugguacauuaccuggua

SEQ ID NO: 8288 - DNA, 54 bp; single-stranded, linear
cuguucucagaaguuucuaccagagaaacacacguugugguacauuaccuggua

SEQ ID NO: 8289 - DNA, 54 bp; single-stranded, linear
aaaccucaagaagcuguuaccagagaaacacacguugugguacauuaccuggua

SEQ ID NO: 8290 - DNA, 54 bp; single-stranded, linear
uuauuaaaagaagaauaaaccagagaaacacacguugugguacauuaccuggua

SEQ ID NO: 8291 - DNA, 54 bp; single-stranded, linear
agucuuuaagaagaaccaaccagagaaacacacguugugguacauuaccuggua

SEQ ID NO: 8292 - DNA, 18 bp; single-stranded, linear
auggucagcugcugggac

SEQ ID NO: 8293 - DNA, 18 bp; single-stranded, linear
gucagcugcugggacacc

SEQ ID NO: 8294 - DNA, 18 bp; single-stranded, linear
caccgcggucuugccuua

SEQ ID NO: 8295 - DNA, 18 bp; single-stranded, linear
acgcgcugcucggguguc

SEQ ID NO: 8296 - DNA, 18 bp; single-stranded, linear
ggugucugcuucucacag

SEQ ID NO: 8297 - DNA, 18 bp; single-stranded, linear
caggccagacucucuuuc

SEQ ID NO: 8298 - DNA, 18 bp; single-stranded, linear
ggaggcagcccacucaug

SEQ ID NO: 8299 - DNA, 18 bp; single-stranded, linear
ggucucugcccacgaccg

SEQ ID NO: 8300 - DNA, 18 bp; single-stranded, linear
cccaucggccugugggag

SEQ ID NO: 8301 - DNA, 18 bp; single-stranded, linear
gaagacagcucaucaucc

SEQ ID NO: 8302 - DNA, 18 bp; single-stranded, linear
auccccugccgggugacg

SEQ ID NO: 8303 - DNA, 18 bp; single-stranded, linear
uaccccugaugggcaaag

SEQ ID NO: 8304 - DNA, 18 bp; single-stranded, linear
uaggacugcugaacugcg

SEQ ID NO: 8305 - DNA, 18 bp; single-stranded, linear
acuaucugacccaucggc

SEQ ID NO: 8306 - DNA, 18 bp; single-stranded, linear
aucggcagaccaauacaa

SEQ ID NO: 8307 - DNA, 18 bp; single-stranded, linear
uacgcccgccgagcccag

SEQ ID NO: 8308 - DNA, 18 bp; single-stranded, linear
ugagacugcuccacgggc

SEQ ID NO: 8309 - DNA, 18 bp; single-stranded, linear
acgggcagacucuugucc

SEQ ID NO: 8310 - DNA, 18 bp; single-stranded, linear
ggcagcggauugaccgga

SEQ ID NO: 8311 - DNA, 18 bp; single-stranded, linear
uacaccugucgcgugaag

SEQ ID NO: 8312 - DNA, 18 bp; single-stranded, linear
cguuccagucuuucaaca

SEQ ID NO: 8313 - DNA, 18 bp; single-stranded, linear
ggaagcagccggugcagg

SEQ ID NO: 8314 - DNA, 18 bp; single-stranded, linear
gaagacgguccuaucggc

SEQ ID NO: 8315 - DNA, 18 bp; single-stranded, linear
ccuaucggcuguccauga

SEQ ID NO: 8316 - DNA, 18 bp; single-stranded, linear
aucggcuguccaugaaag

SEQ ID NO: 8317 - DNA, 18 bp; single-stranded, linear
gaagucugcucgcuauuu

SEQ ID NO: 8318 - DNA, 18 bp; single-stranded, linear
aaccucagaucuacgaaa

SEQ ID NO: 8319 - DNA, 18 bp; single-stranded, linear
ucuauccgcugggcagca

SEQ ID NO: 8320 - DNA, 18 bp; single-stranded, linear
gguggcugacucucagac

SEQ ID NO: 8321 - DNA, 18 bp; single-stranded, linear
acucucagaccccuggaa

SEQ ID NO: 8322 - DNA, 18 bp; single-stranded, linear
aucuacagcugccgggcc

SEQ ID NO: 8323 - DNA, 18 bp; single-stranded, linear
uacagcugccgggccuuc

SEQ ID NO: 8324 - DNA, 18 bp; single-stranded, linear
ugucacagaugugccgaa

SEQ ID NO: 8325 - DNA, 18 bp; single-stranded, linear
gaugccagccgaaggaga

SEQ ID NO: 8326 - DNA, 18 bp; single-stranded, linear
ugaaacuguccugugugg

SEQ ID NO: 8327 - DNA, 18 bp; single-stranded, linear
cacaccugcuucaaaacc

SEQ ID NO: 8328 - DNA, 18 bp; single-stranded, linear
cgccucagaucacuuggu

SEQ ID NO: 8329 - DNA, 18 bp; single-stranded, linear
gcacgcuguuuauugaaa

SEQ ID NO: 8330 - DNA, 18 bp; single-stranded, linear
aagcgcagccuaccucac

SEQ ID NO: 8331 - DNA, 18 bp; single-stranded, linear
uggagcugaucacgcuca

SEQ ID NO: 8332 - DNA, 18 bp; single-stranded, linear
ugaagcggucuucuuccg

SEQ ID NO: 8333 - DNA, 18 bp; single-stranded, linear
aaagacagacuaccuguc

SEQ ID NO: 8334 - DNA, 18 bp; single-stranded, linear
ggacccagaugaaguucc

SEQ ID NO: 8335 - DNA, 18 bp; single-stranded, linear
gugaacggcugcccuaug

SEQ ID NO: 8336 - DNA, 18 bp; single-stranded, linear
aacggcugcccuaugaug

SEQ ID NO: 8337 - DNA, 18 bp; single-stranded, linear
cccaccugccggacugug

SEQ ID NO: 8338 - DNA, 18 bp; single-stranded, linear
ccugccggacuguggcug

SEQ ID NO: 8339 - DNA, 18 bp; single-stranded, linear
aagcucugaugaccgaac

SEQ ID NO: 8340 - DNA, 18 bp; single-stranded, linear
ggccucugauggugaucg

SEQ ID NO: 8341 - DNA, 18 bp; single-stranded, linear
gaaaccuguccaacuacc

SEQ ID NO: 8342 - DNA, 18 bp; single-stranded, linear
uuauucugucucaacaag

SEQ ID NO: 8343 - DNA, 18 bp; single-stranded, linear
ggacgcagccuugcauau

SEQ ID NO: 8344 - DNA, 18 bp; single-stranded, linear
aagccccgccuagacagu

SEQ ID NO: 8345 - DNA, 18 bp; single-stranded, linear
gucagcagcucaaguguc

SEQ ID NO: 8346 - DNA, 18 bp; single-stranded, linear
gucaccagcuccagcuuc

SEQ ID NO: 8347 - DNA, 18 bp; single-stranded, linear
agcuccagcuucccugaa

SEQ ID NO: 8348 - DNA, 18 bp; single-stranded, linear
ccaagcagccccucacca

SEQ ID NO: 8349 - DNA, 18 bp; single-stranded, linear
aagaccugauuuccuaca

SEQ ID NO: 8350 - DNA, 18 bp; single-stranded, linear
uccuacaguuuccaagug

SEQ ID NO: 8351 - DNA, 18 bp; single-stranded, linear
aguuucuguccuccagaa

SEQ ID NO: 8352 - DNA, 18 bp; single-stranded, linear
gaacccugauuaugugag

SEQ ID NO: 8353 - DNA, 18 bp; single-stranded, linear
uucugcagccgccugaag

SEQ ID NO: 8354 - DNA, 18 bp; single-stranded, linear
ugcagccgccugaaggaa

SEQ ID NO: 8355 - DNA, 18 bp; single-stranded, linear
gcaugcggaugagaaccc

SEQ ID NO: 8356 - DNA, 18 bp; single-stranded, linear
ggccccgguuugcugaac

SEQ ID NO: 8357 - DNA, 18 bp; single-stranded, linear
gugaccugcuucaagcca

SEQ ID NO: 8358 - DNA, 18 bp; single-stranded, linear
ccauacugacuagaaaca

SEQ ID NO: 8359 - DNA, 18 bp; single-stranded, linear
aaggacggcuuugcagau

SEQ ID NO: 8360 - DNA, 18 bp; single-stranded, linear
cuuugcagauccacauuu

SEQ ID NO: 8361 - DNA, 18 bp; single-stranded, linear
aagcucugaugaugugag

SEQ ID NO: 8362 - DNA, 18 bp; single-stranded, linear
acuaucagcuggacacua

SEQ ID NO: 8363 - DNA, 18 bp; single-stranded, linear
gcacucugcugggcuccc

SEQ ID NO: 8364 - DNA, 18 bp; single-stranded, linear
ugaagcgguucaccugga

SEQ ID NO: 8365 - DNA, 18 bp; single-stranded, linear
acuuuccgaucugccgag

SEQ ID NO: 8366 - DNA, 18 bp; single-stranded, linear
ccgaucugccgaggccca

SEQ ID NO: 8367 - DNA, 18 bp; single-stranded, linear
aggcccagcuucugcuuc

SEQ ID NO: 8368 - DNA, 18 bp; single-stranded, linear
agcuucugcuucuccagc

SEQ ID NO: 8369 - DNA, 18 bp; single-stranded, linear
uucuccagcuguggccac

SEQ ID NO: 8370 - DNA, 18 bp; single-stranded, linear
gaguccugcuguucucca

SEQ ID NO: 8371 - DNA, 18 bp; single-stranded, linear
uccugcuguucuccaccc

SEQ ID NO: 8372 - DNA, 18 bp; single-stranded, linear
acccccagacuacaacuc

SEQ ID NO: 8373 - DNA, 18 bp; single-stranded, linear
ccuccccgcccgccuaaa

SEQ ID NO: 8374 - DNA, 18 bp; single-stranded, linear
cccgcccgccuaaagcuu

SEQ ID NO: 8375 - DNA, 18 bp; single-stranded, linear
cucaccagccccgacaac

SEQ ID NO: 8376 - DNA, 18 bp; single-stranded, linear
acaaccagccccugacag

SEQ ID NO: 8377 - DNA, 18 bp; single-stranded, linear
cuauuccgcuccacagga

SEQ ID NO: 8378 - DNA, 18 bp; single-stranded, linear
ggagccagcugcuuuucg

SEQ ID NO: 8379 - DNA, 18 bp; single-stranded, linear
gccagcugcuuuucguga

SEQ ID NO: 8380 - DNA, 18 bp; single-stranded, linear
uguugcuguuuugacuaa

SEQ ID NO: 8381 - DNA, 18 bp; single-stranded, linear
ggcgaccgcccgcccacc

SEQ ID NO: 8382 - DNA, 18 bp; single-stranded, linear
accgcccgcccaccggcc

SEQ ID NO: 8383 - DNA, 18 bp; single-stranded, linear
cccugcagcugugggacu

SEQ ID NO: 8384 - DNA, 18 bp; single-stranded, linear
augcacugaccugcucug

SEQ ID NO: 8385 - DNA, 18 bp; single-stranded, linear
cugaccugcucugucucu

SEQ ID NO: 8386 - DNA, 18 bp; single-stranded, linear
cugcucugucucucuuau

SEQ ID NO: 8387 - DNA, 18 bp; single-stranded, linear
ugcguccguccuguggag

SEQ ID NO: 8388 - DNA, 18 bp; single-stranded, linear
ggccuccgcuguuucggg

SEQ ID NO: 8389 - DNA, 18 bp; single-stranded, linear
cuccgcuguuucgggccc

SEQ ID NO: 8390 - DNA, 18 bp; single-stranded, linear
gucuucuguugucuguuu

SEQ ID NO: 8391 - DNA, 18 bp; single-stranded, linear
guugucuguuuaccaucc

SEQ ID NO: 8392 - DNA, 18 bp; single-stranded, linear
aucaucaguuccucuagu

SEQ ID NO: 8393 - DNA, 18 bp; single-stranded, linear
caggccugaccuucgcau

SEQ ID NO: 8394 - DNA, 18 bp; single-stranded, linear
gcauacugcucacgggga

SEQ ID NO: 8395 - DNA, 18 bp; single-stranded, linear
ugguccaguuuggccuag

SEQ ID NO: 8396 - DNA, 18 bp; single-stranded, linear
gccuacugaugggcucaa

SEQ ID NO: 8397 - DNA, 18 bp; single-stranded, linear
uuauccuguuuuauauau

SEQ ID NO: 8398 - DNA, 18 bp; single-stranded, linear
caaggcagucugagagga

SEQ ID NO: 8399 - DNA, 18 bp; single-stranded, linear
aguaucagcccauauuua

SEQ ID NO: 8400 - DNA, 18 bp; single-stranded, linear
uucaucuguuucauaccu

SEQ ID NO: 8401 - DNA, 18 bp; single-stranded, linear
ggugcccgcucuuugggg

SEQ ID NO: 8402 - DNA, 18 bp; single-stranded, linear
cacaccugccggagccgg

SEQ ID NO: 8403 - DNA, 18 bp; single-stranded, linear
ggucacagcugggcagac

SEQ ID NO: 8404 - DNA, 18 bp; single-stranded, linear
cugggcagacgaugaaua

SEQ ID NO: 8405 - DNA, 18 bp; single-stranded, linear
aauagcugcuuugggaga

SEQ ID NO: 8406 - DNA, 18 bp; single-stranded, linear
auucucugaccgggccag

SEQ ID NO: 8407 - DNA, 18 bp; single-stranded, linear
gguaccugcuccccugug

SEQ ID NO: 8408 - DNA, 18 bp; single-stranded, linear
guuuucugucugaugaga

SEQ ID NO: 8409 - DNA, 18 bp; single-stranded, linear
ucugucugaugagacugg

SEQ ID NO: 8410 - DNA, 18 bp; single-stranded, linear
ugagacagccugcagccc

SEQ ID NO: 8411 - DNA, 18 bp; single-stranded, linear
gccugcagcccacugugg

SEQ ID NO: 8412 - DNA, 18 bp; single-stranded, linear
cuugucggcugcagugug

SEQ ID NO: 8413 - DNA, 18 bp; single-stranded, linear
agaaacggaugagaacag

SEQ ID NO: 8414 - DNA, 18 bp; single-stranded, linear
aacagcagccugagguuu

SEQ ID NO: 8415 - DNA, 18 bp; single-stranded, linear
uuauuccgauuuuaauaa

SEQ ID NO: 8416 - DNA, 18 bp; single-stranded, linear
ugguucugcuuaaagacu

SEQ ID NO: 8417 - DNA, 15 bp; single-stranded, linear
ccgggauauuuauaa

SEQ ID NO: 8418 - DNA, 15 bp; single-stranded, linear
aauguauacacaggg

SEQ ID NO: 8419 - DNA, 15 bp; single-stranded, linear
ugcaaauauggaaau

SEQ ID NO: 8420 - DNA, 15 bp; single-stranded, linear
cucccuuaugaugcc

SEQ ID NO: 8421 - DNA, 15 bp; single-stranded, linear
guugaauacugcaaa

SEQ ID NO: 8422 - DNA, 15 bp; single-stranded, linear
uaugguuaaaagaug

SEQ ID NO: 8423 - DNA, 15 bp; single-stranded, linear
gggauauuuauaaga

SEQ ID NO: 8424 - DNA, 15 bp; single-stranded, linear
ggauauuuauaagaa

SEQ ID NO: 8425 - DNA, 15 bp; single-stranded, linear
acgugguuaaccugc

SEQ ID NO: 8426 - DNA, 15 bp; single-stranded, linear
uauuucuagucauga

SEQ ID NO: 8427 - DNA, 15 bp; single-stranded, linear
caauaauagaaggaa

SEQ ID NO: 8428 - DNA, 15 bp; single-stranded, linear
gagacuuaaacuggg

SEQ ID NO: 8429 - DNA, 15 bp; single-stranded, linear
gaugacuaccagggc

SEQ ID NO: 8430 - DNA, 15 bp; single-stranded, linear
uuaauguagaaagaa

SEQ ID NO: 8431 - DNA, 15 bp; single-stranded, linear
gccauuuaugacaaa

SEQ ID NO: 8432 - DNA, 15 bp; single-stranded, linear
gucaaauuacuuaga

SEQ ID NO: 8433 - DNA, 15 bp; single-stranded, linear
auaaaguugggacug

SEQ ID NO: 8434 - DNA, 15 bp; single-stranded, linear
acuugguuuaaaaac

SEQ ID NO: 8435 - DNA, 15 bp; single-stranded, linear
aagugguucaagcau

SEQ ID NO: 8436 - DNA, 15 bp; single-stranded, linear
uucuccuuagguggg

SEQ ID NO: 8437 - DNA, 15 bp; single-stranded, linear
ucuccuuaggugggu

SEQ ID NO: 8438 - DNA, 15 bp; single-stranded, linear
guacucuacuccuga

SEQ ID NO: 8439 - DNA, 15 bp; single-stranded, linear
agcaccuugguugug

SEQ ID NO: 8440 - DNA, 15 bp; single-stranded, linear
ggcaaaucacuugga

SEQ ID NO: 8441 - DNA, 15 bp; single-stranded, linear
caagcaucagcauuu

SEQ ID NO: 8442 - DNA, 15 bp; single-stranded, linear
gagagcuccugagua

SEQ ID NO: 8443 - DNA, 15 bp; single-stranded, linear
aaggccucgcucaag

SEQ ID NO: 8444 - DNA, 15 bp; single-stranded, linear
ucuccauaucaaaac

SEQ ID NO: 8445 - DNA, 15 bp; single-stranded, linear
auguauuuuguauac

SEQ ID NO: 8446 - DNA, 15 bp; single-stranded, linear
cuagaauuucuggaa

SEQ ID NO: 8447 - DNA, 15 bp; single-stranded, linear
cucucuucuggcucc

SEQ ID NO: 8448 - DNA, 15 bp; single-stranded, linear
cuguacuccacccca

SEQ ID NO: 8449 - DNA, 15 bp; single-stranded, linear
acaugguuugguccu

SEQ ID NO: 8450 - DNA, 15 bp; single-stranded, linear
auggucuuugccuga

SEQ ID NO: 8451 - DNA, 15 bp; single-stranded, linear
gcaccauaccuccug

SEQ ID NO: 8452 - DNA, 15 bp; single-stranded, linear
gggcuuuuggaaaag

SEQ ID NO: 8453 - DNA, 15 bp; single-stranded, linear
ccagacuacaacucg

SEQ ID NO: 8454 - DNA, 15 bp; single-stranded, linear
guuuucuccauauca

SEQ ID NO: 8455 - DNA, 15 bp; single-stranded, linear
agaauguaugccucu

SEQ ID NO: 8456 - DNA, 15 bp; single-stranded, linear
auucccuagugagcc

SEQ ID NO: 8457 - DNA, 15 bp; single-stranded, linear
uguuguuccucuucu

SEQ ID NO: 8458 - DNA, 15 bp; single-stranded, linear
gcuuccuuuuaucca

SEQ ID NO: 8459 - DNA, 15 bp; single-stranded, linear
uauauauucucugcu

SEQ ID NO: 8460 - DNA, 15 bp; single-stranded, linear
ccgggauauuuauaa

SEQ ID NO: 8461 - DNA, 15 bp; single-stranded, linear
aguguauccacaggg

SEQ ID NO: 8462 - DNA, 15 bp; single-stranded, linear
ugcaaauuuggaaac

SEQ ID NO: 8463 - DNA, 15 bp; single-stranded, linear
cugccuuaugaugcc

SEQ ID NO: 8464 - DNA, 15 bp; single-stranded, linear
guggaauucugcaaa

SEQ ID NO: 8465 - DNA, 15 bp; single-stranded, linear
ugugguuuaaagaua

SEQ ID NO: 8466 - DNA, 15 bp; single-stranded, linear
gggauauuuauaaag

SEQ ID NO: 8467 - DNA, 15 bp; single-stranded, linear
ggauauuuauaaaga

SEQ ID NO: 8468 - DNA, 15 bp; single-stranded, linear
auguggucaaccuuc

SEQ ID NO: 8469 - DNA, 15 bp; single-stranded, linear
uacuucuugucauca

SEQ ID NO: 8470 - DNA, 15 bp; single-stranded, linear
cucuaauugaaggaa

SEQ ID NO: 8471 - DNA, 15 bp; single-stranded, linear
uugacuucaacuggg

SEQ ID NO: 8472 - DNA, 15 bp; single-stranded, linear
gaggacuuccaggga

SEQ ID NO: 8473 - DNA, 15 bp; single-stranded, linear
aaaauguugaaagaa

SEQ ID NO: 8474 - DNA, 15 bp; single-stranded, linear
acaauuuuugacaga

SEQ ID NO: 8475 - DNA, 15 bp; single-stranded, linear
uucaaauuacuugca

SEQ ID NO: 8476 - DNA, 15 bp; single-stranded, linear
acaaagucgggagag

SEQ ID NO: 8477 - DNA, 15 bp; single-stranded, linear
aaaugguauaaaaau

SEQ ID NO: 8478 - DNA, 15 bp; single-stranded, linear
acaugguacaagcuu

SEQ ID NO: 8479 - DNA, 15 bp; single-stranded, linear
uuuuccuuaggugcu

SEQ ID NO: 8480 - DNA, 15 bp; single-stranded, linear
uuuccuuaggugcuu

SEQ ID NO: 8481 - DNA, 15 bp; single-stranded, linear
gagcucuccuccugu

SEQ ID NO: 8482 - DNA, 15 bp; single-stranded, linear
aguaccuugguuacc

SEQ ID NO: 8483 - DNA, 15 bp; single-stranded, linear
uucaaauuacuugca

SEQ ID NO: 8484 - DNA, 15 bp; single-stranded, linear
gaagcaucagcauaa

SEQ ID NO: 8485 - DNA, 15 bp; single-stranded, linear
ggaagcuccugaaga

SEQ ID NO: 8486 - DNA, 15 bp; single-stranded, linear
ucugccuugcucaag

SEQ ID NO: 8487 - DNA, 15 bp; single-stranded, linear
gguccauuucaaauc

SEQ ID NO: 8488 - DNA, 15 bp; single-stranded, linear
gucuauuauguacau

SEQ ID NO: 8489 - DNA, 15 bp; single-stranded, linear
auggaaucucuggug

SEQ ID NO: 8490 - DNA, 15 bp; single-stranded, linear
uguucuucuggcuac

SEQ ID NO: 8491 - DNA, 15 bp; single-stranded, linear
uuauacuacaccaga

SEQ ID NO: 8492 - DNA, 15 bp; single-stranded, linear
cagugguaugguucu

SEQ ID NO: 8493 - DNA, 15 bp; single-stranded, linear
acggucuaugccauu

SEQ ID NO: 8494 - DNA, 15 bp; single-stranded, linear
augccauuccucccc

SEQ ID NO: 8495 - DNA, 15 bp; single-stranded, linear
uugcuuuuggaagug

SEQ ID NO: 8496 - DNA, 15 bp; single-stranded, linear
auugacuucaacugg

SEQ ID NO: 8497 - DNA, 15 bp; single-stranded, linear
ugcuucuccauaucc

SEQ ID NO: 8498 - DNA, 15 bp; single-stranded, linear
acuaugucugccuug

SEQ ID NO: 8499 - DNA, 15 bp; single-stranded, linear
auacccuugugaaga

SEQ ID NO: 8500 - DNA, 15 bp; single-stranded, linear
uaguguuucucuuga

SEQ ID NO: 8501 - DNA, 15 bp; single-stranded, linear
auauccucuuaucgg

SEQ ID NO: 8502 - DNA, 15 bp; single-stranded, linear
gaaauauccucuuau

What is claimed is:

1. A nucleic acid molecule which specifically inhibits the synthesis, expression and/or stability of an mRNA encoding flt-1 receptor of human or mouse vascular endothelial growth factor, wherein said nucleic acid molecule is an enzymatic nucleic acid molecule or an antisense nucleic acid molecule.

2. The nucleic acid of claim 1, wherein said nucleic acid molecule is an enzymatic nucleic acid molecule.

3. The nucleic acid molecule of claim 2, wherein said enzymatic nucleic acid molecule comprises binding arms containing sequence complementary to a substrate nucleotide base sequence to any one of SEQ ID NOS; 1481–1482, 1493, 1574, 1664, 1669, 1838, 1847, 1913, 1933, 1974, 1984, 1997, 1999, 2000, 2025, 2130, 2382, or 2394.

4. The nucleic acid molecule of claims 2, wherein said nucleic acid molecule is in a hammerhead motif.

5. The nucleic acid molecule of claim 2, wherein said nucleic acid molecule is in a hairpin, hepatitis Delta virus, group I intron, VS nucleic acid or RNase P nucleic acid motif.

6. A method of cleaving RNA of flt-1 gene comprising the step of contacting said RNA with the enzymatic nucleic acid molecule of claim 3, under conditions suitable for the cleavage of said RNA.

7. The method claim 6, wherein said enzymatic nucleic acid molecule is in a hammerhead motif.

8. The method of claim 6, wherein said enzymatic nucleic acid molecule comprises between 12 and 100 bases complementary to the RNA of flt-1 gene.

9. The method of claim 6, wherein said enzymatic nucleic acid molecule comprises between 14 and 24 bases complementary to the RNA of flt-1 gene.

10. The nucleic acid molecule of claim 1, wherein said nucleic acid molecule comprises between 12 and 100 bases complementary to the RNA encoding the flt-1 receptor.

11. The nucleic acid molecule of claim 10, wherein said nucleic acid molecule comprises between 14 and 24 bases complementary to the RNA encoding the flt-1 receptor.

12. A mammalian cell including a nucleic acid molecule of claim 1, wherein said mammalian cell is not a living human.

13. The mammalian cell of claim 12, wherein said mammalian cell is a human cell.

14. An expression vector comprising nucleic acid sequence encoding the nucleic acid molecule of claim 1, in a manner which allows expression and/or delivery of that nucleic acid molecule within a mammalian cell.

15. The expression vector of claim 14, wherein said nucleic acid molecule is an enzymatic nucleic acid.

16. A mammalian cell including an expression vector of claim 11, wherein said mammalian cell is not a living human.

17. The mammalian cell of claim 16, wherein said mammalian cell is a human cell.

18. The nucleic acid molecule of claim 1, wherein said nucleic acid molecule is an antisense nucleic acid molecule.

19. The nucleic acid molecule of claim 18, wherein said antisense nucleic acid molecule contains sequence complementary to the substrate nucleotide base sequence selected from the group consisting of: 1481–1482, 1493, 1574, 1664, 1669, 1838, 1847, 1913, 1933, 1974, 1984, 1997, 1999, 2000, 2025, 2130, 2382, or 2394.

20. An expression vector comprising nucleic acid sequence encoding the antisense nucleic acid molecule of claim 18, in a manner which allows expression and/or delivery of that antisense nucleic acid molecule within a mammalian cell.

21. A mammalian cell including the expression vector of claim 20, wherein said mammalian cell is not a living human.

22. The mammalian cell of claim 21, wherein said mammalian cell is a human cell.

23. An enzymatic nucleic acid molecule comprising any ribozyme sequence selected from the group consisting of: SEQ ID NOS: 50–51, 62, 143, 233, 238, 407, 416–417, 482, 502, 543, 553, 566, 568–569, 574, 594, 699, 951, and 963.

* * * * *

UNITED STATES PATENT AND TRADEMARK OFFICE
CERTIFICATE OF CORRECTION

PATENT NO. : 6,346,398 B1  Page 1 of 1
DATED : February 12, 2002
INVENTOR(S) : Pamela Pavco, James McSwiggen, Daniel Stinchcomb and Jaime Escobedo It is certified that error appears in the above-identified patent and that said Letters Patent is hereby corrected as shown below:

<u>Title page,</u>
Item [73], after "Boulder, CO (US)", please add -- Chiron Corporation, Emeryville, CA (US) --

Signed and Sealed this

Twelfth Day of November, 2002

Attest:

Attesting Officer

JAMES E. ROGAN
*Director of the United States Patent and Trademark Office*